(12) United States Patent
Lippincott et al.

(10) Patent No.: US 10,766,959 B2
(45) Date of Patent: Sep. 8, 2020

(54) ANTI-C10ORF54 ANTIBODIES AND USES THEREOF

(71) Applicant: PIERRE FABRE MEDICAMENT, Boulogne-Billancourt (FR)

(72) Inventors: John Lippincott, Burlingame, CA (US); Edward Thein Htun Van Der Horst, Burlingame, CA (US); Sung Young Kim, Burlingame, CA (US); Leonard G Presta, Burlingame, CA (US); Jan-Willem Theunissen, Burlingame, CA (US)

(73) Assignee: Pierre Fabre Medicament, Boulogne-Billancourt (FR)

( * ) Notice: Subject to any disclaimer, the term of this patent is extended or adjusted under 35 U.S.C. 154(b) by 0 days.

(21) Appl. No.: 15/534,982

(22) PCT Filed: Dec. 11, 2015

(86) PCT No.: PCT/US2015/065331
§ 371 (c)(1),
(2) Date: Jun. 9, 2017

(87) PCT Pub. No.: WO2016/094837
PCT Pub. Date: Jun. 16, 2016

(65) Prior Publication Data
US 2019/0177415 A1 Jun. 13, 2019

Related U.S. Application Data

(60) Provisional application No. 62/090,880, filed on Dec. 11, 2014.

(51) Int. Cl.
| | |
|---|---|
| *C07K 16/00* | (2006.01) |
| *C07K 16/30* | (2006.01) |
| *C07K 16/40* | (2006.01) |
| *C07K 16/28* | (2006.01) |
| *A61K 39/395* | (2006.01) |
| *A61K 47/68* | (2017.01) |
| *A61P 35/00* | (2006.01) |
| *A61K 31/4025* | (2006.01) |
| *A61K 31/404* | (2006.01) |
| *A61K 31/5517* | (2006.01) |
| *A61K 39/00* | (2006.01) |

(52) U.S. Cl.
CPC ........ *C07K 16/2827* (2013.01); *A61K 31/404* (2013.01); *A61K 31/4025* (2013.01); *A61K 31/5517* (2013.01); *A61K 39/39558* (2013.01); *A61K 47/6803* (2017.08); *A61K 47/6851* (2017.08); *A61K 47/6873* (2017.08); *A61P 35/00* (2018.01); *A61K 2039/505* (2013.01); *C07K 2317/24* (2013.01); *C07K 2317/565* (2013.01); *C07K 2317/567* (2013.01); *C07K 2317/73* (2013.01); *C07K 2317/74* (2013.01); *C07K 2317/92* (2013.01)

(58) Field of Classification Search
CPC ........ C07K 16/00; C07K 16/20; C07K 16/30; C07K 16/40
USPC ................................ 424/133.1, 136.1, 178.1
See application file for complete search history.

(56) References Cited

U.S. PATENT DOCUMENTS

| | | |
|---|---|---|
| 3,710,795 A | 1/1973 | Higuchi et al. |
| 3,773,919 A | 11/1973 | Boswell et al. |
| RE28,819 E | 5/1976 | Thompson |
| 4,044,126 A | 8/1977 | Cook et al. |
| 4,328,245 A | 5/1982 | Yu et al. |
| 4,358,603 A | 11/1982 | Yu |
| 4,364,923 A | 12/1982 | Cook et al. |
| 4,409,239 A | 10/1983 | Yu |
| 4,410,545 A | 10/1983 | Cook et al. |
| 4,414,209 A | 11/1983 | Cook et al. |
| 4,444,887 A | 4/1984 | Hoffmann |
| 4,485,045 A | 11/1984 | Regen |
| 4,522,811 A | 6/1985 | Eppstein et al. |
| 4,526,938 A | 7/1985 | Churchill et al. |
| 4,544,545 A | 10/1985 | Ryan et al. |
| 4,676,980 A | 6/1987 | Segal et al. |
| 4,716,111 A | 12/1987 | Osband et al. |
| 4,816,397 A | 3/1989 | Boss et al. |
| 4,816,567 A | 3/1989 | Cabilly et al. |
| 4,880,078 A | 11/1989 | Inoue et al. |
| 4,980,286 A | 12/1990 | Morgan et al. |
| 5,013,556 A | 5/1991 | Woodle et al. |
| 5,112,946 A | 5/1992 | Maione |
| 5,122,464 A | 6/1992 | Wilson et al. |
| 5,128,326 A | 7/1992 | Balazs et al. |
| 5,223,409 A | 6/1993 | Ladner et al. |

(Continued)

FOREIGN PATENT DOCUMENTS

| | | |
|---|---|---|
| EP | 0 239 400 B1 | 9/1987 |
| EP | 037 166 A1 | 10/1988 |

(Continued)

OTHER PUBLICATIONS

J. L. Lines, et al., "VISTA is an immune checkpoint molecule for human T cells," Cancer Res., 74(7): 1924-1932 (2014).

(Continued)

*Primary Examiner* — Lynn A Bristol
(74) *Attorney, Agent, or Firm* — Finnegan, Henderson, Farabow, Garrett & Dunner, L.L.P.

(57) ABSTRACT

The present disclosure relates generally to anti-C10orf54 antibodies, including antibody-drug conjugates comprising the antibodies, and methods of their use.

15 Claims, 51 Drawing Sheets

Specification includes a Sequence Listing.

(56) References Cited

U.S. PATENT DOCUMENTS

| | | |
|---|---|---|
| 5,225,539 A | 7/1993 | Winter |
| 5,290,540 A | 3/1994 | Prince et al. |
| 5,314,995 A | 5/1994 | Fell, Jr. et al. |
| 5,336,603 A | 8/1994 | Capon et al. |
| 5,349,053 A | 9/1994 | Landolfi |
| 5,359,046 A | 10/1994 | Capon et al. |
| 5,403,484 A | 4/1995 | Ladner et al. |
| 5,413,923 A | 5/1995 | Kucherlapati et al. |
| 5,427,908 A | 6/1995 | Dower et al. |
| 5,441,050 A | 8/1995 | Thurston et al. |
| 5,447,851 A | 9/1995 | Beutler et al. |
| 5,516,637 A | 5/1996 | Huang et al. |
| 5,530,101 A | 6/1996 | Queen et al. |
| 5,545,806 A | 8/1996 | Lonberg et al. |
| 5,565,332 A | 10/1996 | Hoogenboom et al. |
| 5,569,825 A | 10/1996 | Lonberg et al. |
| 5,571,698 A | 11/1996 | Ladner et al. |
| 5,580,717 A | 12/1996 | Dower et al. |
| 5,585,089 A | 12/1996 | Queen et al. |
| 5,605,793 A | 2/1997 | Stemmer |
| 5,618,709 A | 4/1997 | Gewirtz et al. |
| 5,622,929 A | 4/1997 | Willner et al. |
| 5,625,126 A | 4/1997 | Lonberg et al. |
| 5,633,425 A | 5/1997 | Lonberg et al. |
| 5,658,727 A | 8/1997 | Barbas et al. |
| 5,661,016 A | 8/1997 | Lonberg et al. |
| 5,679,377 A | 10/1997 | Bernstein et al. |
| 5,698,426 A | 12/1997 | Huse |
| 5,709,874 A | 1/1998 | Hanson et al. |
| 5,723,125 A | 3/1998 | Change et al. |
| 5,733,743 A | 3/1998 | Johnson et al. |
| 5,734,033 A | 3/1998 | Reed |
| 5,750,753 A | 5/1998 | Kimae et al. |
| 5,759,542 A | 6/1998 | Gurewich |
| 5,766,886 A | 6/1998 | Studnicka et al. |
| 5,780,225 A | 7/1998 | Wigler et al. |
| 5,783,181 A | 7/1998 | Browne et al. |
| 5,807,715 A | 9/1998 | Morrison et al. |
| 5,811,238 A | 9/1998 | Stemmer et al. |
| 5,814,318 A | 9/1998 | Lonberg et al. |
| 5,821,047 A | 10/1998 | Garrard et al. |
| 5,824,307 A | 10/1998 | Johnson |
| 5,837,458 A | 11/1998 | Minshull et al. |
| 5,840,674 A | 11/1998 | Yatvin et al. |
| 5,844,095 A | 12/1998 | Linsley et al. |
| 5,855,913 A | 1/1999 | Hanes et al. |
| 5,860,957 A | 1/1999 | Jacobsen et al. |
| 5,874,064 A | 2/1999 | Edwards et al. |
| 5,885,834 A | 3/1999 | Epstein |
| 5,900,252 A | 5/1999 | Calanchi et al. |
| 5,908,626 A | 6/1999 | Chang et al. |
| 5,916,597 A | 6/1999 | Lee et al. |
| 5,934,272 A | 8/1999 | Lloyd et al. |
| 5,939,598 A | 8/1999 | Kucherlapati et al. |
| 5,948,433 A | 9/1999 | Burton et al. |
| 5,969,108 A | 10/1999 | McCafferty et al. |
| 5,972,366 A | 10/1999 | Haynes et al. |
| 5,983,134 A | 11/1999 | Ostrow |
| 5,985,307 A | 11/1999 | Hanson et al. |
| 5,985,309 A | 11/1999 | Edwards et al. |
| 5,985,317 A | 11/1999 | Venkateshwaran et al. |
| 5,985,320 A | 11/1999 | Edwards et al. |
| 5,989,463 A | 11/1999 | Tracy et al. |
| 5,998,596 A | 12/1999 | Bergan et al. |
| 6,004,534 A | 12/1999 | Langer et al. |
| 6,005,079 A | 12/1999 | Casterman et al. |
| 6,010,715 A | 1/2000 | Wick et al. |
| 6,019,968 A | 2/2000 | Platz et al. |
| 6,024,975 A | 2/2000 | D'Angelo et al. |
| 6,039,975 A | 3/2000 | Shah et al. |
| 6,048,736 A | 4/2000 | Kosak |
| 6,054,297 A | 4/2000 | Carter et al. |
| 6,060,082 A | 5/2000 | Chen et al. |
| 6,071,495 A | 6/2000 | Unger et al. |
| 6,120,751 A | 9/2000 | Unger |
| 6,131,570 A | 10/2000 | Schuster et al. |
| 6,139,865 A | 10/2000 | Friend et al. |
| 6,167,301 A | 12/2000 | Flower et al. |
| 6,256,533 B1 | 7/2001 | Yuzhakov et al. |
| 6,261,595 B1 | 7/2001 | Stanley et al. |
| 6,267,983 B1 | 7/2001 | Fujii et al. |
| 6,271,359 B1 | 8/2001 | Norris et al. |
| 6,274,552 B1 | 8/2001 | Tamarkin et al. |
| 6,277,832 B1 | 8/2001 | Sugiyama et al. |
| 6,316,652 B1 | 11/2001 | Steliou |
| 6,331,415 B1 | 12/2001 | Cabilly et al. |
| 6,407,213 B1 | 6/2002 | Carter et al. |
| 6,639,055 B1 | 10/2003 | Carter et al. |
| 6,719,971 B1 | 4/2004 | Carter et al. |
| 6,800,738 B1 | 10/2004 | Carter et al. |
| 2005/0042664 A1 | 2/2005 | Wu et al. |
| 2011/0021568 A1 | 1/2011 | Ellman et al. |
| 2014/0341920 A1 | 11/2014 | Noelle |
| 2016/0159927 A1* | 6/2016 | Molloy ............... C12N 15/1138 424/139.1 |

FOREIGN PATENT DOCUMENTS

| | | |
|---|---|---|
| EP | 0 307 434 B1 | 3/1989 |
| EP | 0 394 827 A1 | 10/1990 |
| EP | 0 396 387 B1 | 11/1990 |
| EP | 0 519 596 B1 | 12/1992 |
| EP | 0 592 106 B1 | 4/1994 |
| WO | WO 86/05807 | 10/1986 |
| WO | WO 89/01036 | 2/1989 |
| WO | WO 89/12624 | 12/1989 |
| WO | WO 90/02809 | 3/1990 |
| WO | WO 91/05548 | 5/1991 |
| WO | WO 91/06570 | 5/1991 |
| WO | WO 91/09967 | 7/1991 |
| WO | WO 91/10737 | 7/1991 |
| WO | WO 91/10741 | 7/1991 |
| WO | WO 91/14438 | 10/1991 |
| WO | WO 92/01047 | 1/1992 |
| WO | WO 92/08495 | 5/1992 |
| WO | WO 92/18619 | 10/1992 |
| WO | WO 91/19244 | 11/1992 |
| WO | WO 92/22324 | 12/1992 |
| WO | WO 93/11236 | 6/1993 |
| WO | WO 93/17105 | 9/1993 |
| WO | WO 94/04678 | 3/1994 |
| WO | WO 94/25591 | 11/1994 |
| WO | WO 95/15982 | 6/1995 |
| WO | WO 95/20401 | 8/1995 |
| WO | WO 96/04388 | 2/1996 |
| WO | WO 96/20698 | 7/1996 |
| WO | WO 96/22024 | 7/1996 |
| WO | WO 96/33735 | 10/1996 |
| WO | WO 96/34096 | 10/1996 |
| WO | WO 97/13844 | 4/1997 |
| WO | WO 97/32572 | 9/1997 |
| WO | WO 97/33899 | 9/1997 |
| WO | WO 97/34631 | 9/1997 |
| WO | WO 97/34911 | 9/1997 |
| WO | WO 97/44013 | 9/1997 |
| WO | WO 98/16654 | 4/1998 |
| WO | WO 98/24893 | 6/1998 |
| WO | WO 98/31346 | 7/1998 |
| WO | WO 98/45479 | 10/1998 |
| WO | WO 98/46645 | 10/1998 |
| WO | WO 98/50433 | 11/1998 |
| WO | WO 99/04813 | 2/1999 |
| WO | WO 99/15154 | 4/1999 |
| WO | WO 99/20253 | 4/1999 |
| WO | WO 99/23105 | 5/1999 |
| WO | WO 99/66903 | 12/1999 |
| WO | WO 2007/044515 A1 | 4/2007 |
| WO | WO 2014/039983 A1 | 3/2014 |

OTHER PUBLICATIONS

Ames, R. et al. "Conversion of murine Fabs isolated from a combinatorial phage display library to full length immunoglobulins," *Journal of Immunological Methods.*, 184:177-186 (1995).

(56) References Cited

OTHER PUBLICATIONS

Al-Lazikani, B. et al. "Standard Conformations for the Canonical Structures of Immunoglobulins," *J. Mol. Biol.* 273: 927-948 (1997).
Ashkenazi, A. et al. "Protection Against Endotoxic Shock by a Tumor Necrosis Factor Receptor Immunoadhesin," *Proc. Natl. Acad. Sci.*, 88:10535-10539 (1991).
Baca, M. et al. "Antibody Humanization Using Monovalent Phage Display," *J. Bio. Chem.*, 272:10678-10684 (1997).
Berman, H. et al. "The Protein Data Bank," *Nucl. Acids. Res.*, 28:235-242 (2000).
Better, M. et al. "*Escherichia coli* Secretion of an Active Chimeric Antibody Fragment," *International Genetic Engineering, Inc.* 1041 (1988).
Bitter, G. et al. "Vectors for Expression of Cloned Genes," 153: 516-544 (1987).
Brickmann, U. et al. "Phage display of disulfide-stabilized Fv fragments," *Journal of Immunological Methods.*, 182: 41-50 (1995).
Buchwald, H. et al. "Long-term, continuous intravenous heparin administration by an implantable infusion pump in ambulatory patients with recurrent venous thrombosis," Surgery., 507.
Burton, D. et al. "Human Antibodies From Combinatorial Libraries," Adv. Immunol., 57:191-280 (1994).
Caldas, C. et al. "Design and synthesis of germline-based hemi-humanized single-chain Fv against the CD18 surface antigen," *Protein Engineering.*, 13:353-360 (2000).
Carter, P. et al. "Humanization of an anti-p185$^{HER2}$ antibody for human cancer therapy," *Proc. Natl. Acad. Sci.*, 89:4285-4289 (1992).
Chothia, C. et al. "Canonical Structures for the Hypervariable Regions of Immunoglobulins," *J. Mol. Biol.* 196:901-917 (1987).
Chothia, C. et al. "Structural Determinants in the Sequences of Immunoglobulin Variable Domain," *J. Mol. Biol.* 278: 457-479 (1998).
Cleek, R. et al. "Biodegradable Polymeric Carriers for a bFGF Antibody for Cardiovascular Application," Institute of Biosciences and Bioengineering., 853 (1997).
Colbere-Garapin, F. et al. "A New Dominant Hybrid Selective Marker for Higher Eukaryotic Cells," *J. Mol. Biol.* 150:1-14 (1981).
Couto, J. et al. "Designing Human Consensus Antibodies with Minimal Positional Templates," *American Association for Cancer Research.*, 55:5973-5977 (1995).
Crouse, G. et al. "Expression and Amplification of Engineered Mouse Dihydrofolate Reductase Minigenes," *American Society for Microbiology.*, 3:257-266 (1983).
DeNardo, G. et al. "Comparison of 1,4,7,10-Tetraazacyclododecane-N,N', N'', N'''-tetraacetic acid (DOTA)-Peptide-ChL6, a Novel Immunoconjugate with Catabolizable Linker, to 2-Iminothiolane-2-[p-(Bromoacetamido)benzyle]-DOTA-ChL6 in Breast Cancer Xenografts," *American Association for Cancer Research.*, 4:2483-2490 (1998).
During, M. et al. "Controlled release of dopamine from a polymeric brain implant: in vivo characterization," *Annals of Neurology.*, 25:351-356(1989).
Edelman, G. et al. "The covalent structure of an entire-$_\gamma$G immunoglobulin molecule*," *Biochem.*, 63:78-81, (1969).
Ellman, G. et al. "A New and Rapid Colorimetric Determination of Cetylcholinesterase Activity," *Biochemical Pharmacology.*, 7:88-95 (1960).
Eppstein, D. et al. "Biological activity of liposome-encapsulated murine interferon y is mediated by a cell membrane receptor," *Proc. Natl. Acad. Sci.*, 82:3688-3692 (1985).
Flajnik, M. et al. "Evolution of the 87 family: Co-evolution of 87H6 and NKp30, identification of a new 87 family member, 87H7, and of 87's historical relationship with the MHC," *NIH Public Access.*, 64(8):571-590 (2012).
Flies, D. et al. "Cutting Edge: A Monoclonal Antibody Specific for the Programmed Death-1 Homolog Prevents Graft-versus-Host Disease in Mouse Models," *The Journal of Immunology.*, 187:1537-1541 (2017).

Foecking, M. et al. "Powerful and versatile enhancer-promoter unit for mammalian expression vectors." *Elsevier Science Publishers.*, 45:101-105 (1986).
Gabizon, A. et al. "Pharmacokinetics and Tissue Distribution of Doxorubicin Encapsulated in Stable Liposomes With Long Circulation Times," *J Natl Cancer Inst.* 81:1484-1488 (1989).
Gentz, R. et al. "Bioassay for trans-activation using purified human immunodeficiency virus tat-encoded protein:Trans-activation requires mRNA synthesis," *Proc. Natl. Acad. Sci. USA.*, 86:821-824 (1989).
Gillies, S. et al. "High-level expression of chimeric antibodies using adapted cDNA variable region cassettes," Journal of Immunological Methods., 125:191-202 (1989).
Greenspan, N. et al. "I diotypes: structure and immunogenicity," *The FASEB Journal.*, 7:437-444 (2017).
Guex, N. et al. "Swiss-Model and the Swiss-PdbViewer: An environment for comparative protein modeling," Electrophoresis., 18:2714-2723 (1997).
Hansson, L. et al. "Evolution of Differential Substrate Specificities in Mu Class Glutathione Transferases Probed by DNA Shuffling," *J. Mol. Biol.* 287:265-276 (1999).
Harayama, S. "Artificial evolution by DNA shuffling," *Tibtech.*, 16:76-82 (1998).
Hellstrom, K. et al. "Antibodies for Drug Delivery," *Tumor Institute.*, 623-653 (1987).
Howard, M. et al. "Intracerebral drug delivery in rats with lesion-induced memory deficits," *J. Neurosurg.* 71:105-112 (1989).
Hwang, K. et al. "Hepatic uptake and degradation of unilamellar sphingomyelin/ cholesterol liposomes: A kinetic study," *Proc. Natl. Acad. Set USA.*, 77:4030-4034 (1980).
International Search Report for PCT/US2015/065331 dated Jun. 13, 2014.
Inouye, S. et al. "Up-promoter mutations in the Ipp gene or *Escherichia coli*," *Nucleic Acids Res.*, 13: 3101-3110 (1985).
Jalkanen, M. et al. "Cell Surface Proteoglycan of Mouse Mammary Epithelial Cells Is Shed by Cleavage of Its Matrix-binding Ectodomain from Its Membrane-associated Domain," *The Journal of Cell Biology.*, 105:3087-3096 (1987).
Jalkanen, M. et al. "Heparan Sulfate Proteoglycans from Mouse Mammary Epithelial Cells: Localization on the Cell Surface with a Monoclonal Antibody," *The Journal of Cell Biology.*, 101: 976-984 (1985).
Johnson, S. et al. "Development of a Humanized Monoclonal Antibody (MEDI-493) with Potent in Vitro and in Vivo Activity against Respiratory Syncytial Virus," *The Journal of Infectious Diseases* 1(176:1215-24. (1997).
Joliot, A. et al. "Antennapedia homeobox peptide regulates neural morphogenesis," *Proc. Natl. Acad. Sci USA.*, 88:1864-1868 (1991).
Jones, P. et al. "Replacing the complementarity determining regions in a human antibody with those from a mouse," *Nature* 321:1-4 (1986).
Kabat, E. et al. "Unusual Distributions of Amino Acids in Complementarity determining (Hypervariable) Segments of Heavy and Light Chains of Immunoglobulins and Their Possible Roles in Specificity of Antibody-combining Sites," *The Journal of Biological Chemistry.*, 252:6609-6616 (1977).
Goelz, S. et al. "Inhibition of Calcification of Bioprosthetic Heart Valves by Local Controlled-Release Diphosphonate," Science., 228:190.
Kantarjian, H. et al. "Treatment of Philadelphia Chromosome-positive, Accelerated-phase Chronic Myelogenous Leukemia with Imatinib Mesylate," *American Association for Cancer Research.*, 8:2167-2176 (2002).
Keller, A. et al. "Empirical Statistical Model to Estimate the Accuracy of Peptide Identifications Made by MSAVIS and Database Search," *Institute for Systems Biology.*, 74:5383-5392 (2002).
Kettleboroug, C. et al. "Isolation of tumor cell-specific single-chain Fv from immunized mice using phage-antibody libraries and the re-construction of whole antibodies from these antibody fragments," *Eur. J. Immunol.*, 24:952-958 (1994).
Kilpatrick, K. et al. "Rapid Development of Affinity Matured Monoclonal Antibodies Using RIMMS," *Hybridoma.*, 16:381- (1997).
Kohler, G. et al. "Immunoglobulin chain loss in hybridoma lines," *Proc. Natl. Acad. Sci. USA.*, 77:2197-2199 (1980).

(56) References Cited

OTHER PUBLICATIONS

Kohler, G. et al. "Pillars Article: Continuous cultures of fused cells secreting antibody of predefined Specificity," *The Journal of Immunology.*, 174:495-497 (2017).
Lam, X. et al. "Microencapsulation of Recombinant Humanized Monoclonal Antibody for Local Delivery." *Proceed Int'l. Symp Contorl Rel. Bioact Matter*, 24:759-760 (1997).
Langer, R. et al. "Chemical and Physical Structure of Polymers as Carriers for Controlled Release of Bioactive Agents: A Review," *Journal of Macromolecular Science*, Part C., 23:1 61-126 (1983).
Langer, R. et al. "New Methods of Drug Delivery," *Science*, 1527-1533 (1990).
Lefranc, M. et al. "IMGT unique numbering for immunoglobulin and T cell receptor variable domains and Ig superfamily V-like domains," *Developmental and Comparative Immunology.*, 27:55-77 (2002).
Liu, H. et al. "A Model for Random Sampling and Estimation of Relative Protein Abundance in Shotgun Proteomics," *Analytical Chemistry* 76:4193-4201 (2004).
Logan, J. et al. "Adenovirus tripartite leader sequence enhances translation of mRNAs late after infection," *Proc. Natl. Acad. Sci. USA* 81:3655-3659 (1984).
Lonberg, N. et al. "Human Antibodies from Transgenic Mice," *International Review of Immunology.*, 13:65-93(1995).
Lorennzo, M. et al. "PCR-Based Method for the Introduction of Mutations in Genes Cloned and Expressed in Vaccinia Virus," *Bio Techniques.*, 24:308-313 (1998).
Lowry, I. et al. "Isolation of Transforming DNA: Cloning the Hamster aprt Gene," *College of Physicians and Surgeons, Columbia University.*, 22:817-823 (1980).
Lowry, O. et al. "Protein Measurement With the Folin Phenol Reagent," *J. Biol. Chem.*, 193:265-275. (1951).
Lundgren, D. et al. "Protein Identification Using Sorcerer 2 and SEQUEST," *Current Protocols in Bioinformatics.*, 13.3. 1-13.3.21 (2009).
Martin, F. et al. "Irreversible Coupling of Immunoglobulin Fragments to Preformed Vesicles," *Cancer Research Institute.*, 257:286-288 (1982).
Mohammad, R. et al. "A new tubulin polymerization inhibitor, auristatin Pe, induces tumor regression in a human Waldenstrom's macroglobulinemia xenograft model," *International Journal of Oncology.*,15:367-372 (1999).
Mohammad, R. et al. "Bryostatin 1 induces differentiation and potentiates the antitumor effect of Auristatin PE in a human pancreatic tumor (PANC-1) xenograft model," *Anti-Cancer Drugs.*, 12:735-740 (2001).
Moore, A. et al. "Apoptosis in CHO cell batch cultures: examination by flow cytometry," *Cytotechnology.*, 17:1-11 (1995).
Morgan, R. et al. "Human Gene Therapy," *Annu. Rev. Biochem.*, 62:191-217 (1993).
Morrison, S. et al. "Chimeric human antibody molecules: Mouse antigen-binding domains with human constant region domains," *Proc. Natl. Acad. Sci. USA.*, 81: 6851-6855 (1984).
Morrison, S. et al. "Transfectomas Provide Novel Chimeric Antibodies," *Science.*, 229:1202-1207 (1985).
Mulligan, R et al."The Basic Science of Gene Therapy," *Science.*, 260:926 (1993).
Mulligan, R et al. "Selection for animal cells that express the *Escherichia coli* gene coding for xanthine-guanine phosphoribosyltransferase," *Proc. Natl. Acad. Sci. USA* 78:2072-2076 (1981).
Mullinax, R. et al. "Expression of a Heterodimeric Fab Antibody Protein in One Cloning Step," Research Report, 1-5.
Muyldermans, S. "Single domain camel antibodies: current status," 74:277-302 (2001).
Neilson, K. et al. "Less label, more free: Approaches in label-free quantitative mass spectrometry," *Proteomics.*, 11:535-553 (2011).
Nesvizhskii, A. et al. "A Statistical Model for Identifying Proteins by Tandem Mass Spectrometry," *Anal. Chem.*, 75:4646-4658 (2003).

Nicolaou, K. et al. "Calicheamicin $\theta^1{}_1$: A Rationally Designed Molecule with Extremely Potent and Selective DNA Cleaving Properties and Apoptosis Inducing Activity," *Angew. Chem. Int. Ed. Engl.*, 33:183-186 (1994).
Ning, S. et al. "Intratumoral radioimmunotherapy of a human colon cancer xenograft using a sustained-release gel," *Radiotheraphy & Oncology.*, 39:179-189 (1996).
Nisonoff, A. "Idiotypes: concepts and applications.," *The Journal of Immunology.*, 147:2429-2438 (2017).
Nuttall, S. et al. "Immunoglobulin $V_H$ Domains and Beyond: Design and Selection of Single-Domain Binding and Targeting Reagents," *Current pharmaceutical Biotechnology.*, 253-263 (2000).
O'Hare, K. et al. "Transformation of mouse fibroblasts to methotrexate resistance by a recombinant plasmid expressing a prokaryotic dihydrofolate reductase," *Proc. Natl. Acad. Sci. USA.*, 78: 1527-1531 (1981).
Oi, V. et al. "Chimeric Antibodies," *BioTechniques*, 4:214 (1986).
Olsen, J. et al. "A Dual Pressure Linear Ion Trap Orbitrap Instrument with Very High Sequencing Speed," *The American Society for Biochemistry and Molecular Biology, Inc.*, 8:2759-2769 (2009).
Oppermann, H. et al. "Antigen recognition and targeted delivery by the single-chain Fv," *ResearchGate.*, (1993).
Padlan, E. "A Possible Procedure for Reducing the Immunogenicity of Antibody Variable Domains While Preserving Their Ligand-Binding Properties," *Molecular Immunology.*, 28:489-498 (1991).
Patten, P. et al. "Applications of DNA shuffling to pharmaceuticals and vaccines," *Current Opinion in Biotechnology.*, 8:724-733 (1997).
Pedersen, J. et al. "Comparison of Surface Accessible Residues in Human and Murine Immunoglobulin Fv Domains," *J. Mol. Biol.* 235:959-973 (1994).
Persic, L. et al. "An integrated vector system for the eukaryotic expression of antibodies or their fragments after selection from phage display libraries," *Gene.*, 187:9-18 (1997).
Peterson, J. et al. "Enzymatic Cleavage of Peptide-Linked Radiolabels from Immunoconjugates," *The American Chemical Society.*, 10:553-557 (1999).
Presta, L. "Antibody engineering," *Current Opinion in Structural Biology.*, 2:593-596 (1992).
Proudfoot, N. "Transcriptional interference and termination between duplicated α-globin gene constructs suggests a novel mechanism for gene regulation," Nature., 322:562-565 (1986).
Riechmann, L. et al. "Reshaping human antibodies for therapy," *Nature.*, 332:1-5 (1988).
Rogushka, M. et al. "A comparison of two murine monoclonal antibodies humanized by CDR-grafting and variable domain resurfacing," *Protein Engineering.*, 9:895-904 (1996).
Rüther, U. et al. "Easy identification of cDNA clones," *The EMBO Journal.*, 2:1791-1794 (1983).
Sandhu, J. "A rapid procedure for the humanization of monoclonal antibodies," *Gene.*, 150:409-410 (1994).
Santerre, R. et al. "Expression of prokaryotic genes for hygromycin B and G418 resistance as dominant-selection markers in mouse L cells," Lilly Research Laboratories., 147-146 (1984).
Sauder, C. et al. "A Preliminary Trial of the Programmable Implantable Medication System for Insulin Delivery," *The New England Journal of Medicine.*, 574 (1989).
Sawai, H. et al. "Direct Production of the Fab Fragment Derived From the Sperm Immobilizing Antibody Using Polymerase Chain Reaction and cDNA Expression Vectors," *American Journal of Reproductive Immunology.*, 34:26-34 (1995).
Song, Y. et al. "Antibody Mediated Lung Targeting of Long-Circulating Emulsions," *PDS Journal Pharmaceutical Science and Techology.*, 50:372-377 (1996).
Studinicka, G. et al. "Human-engineered monoclonal antibodies retain full specific binding activity by preserving non-CDR complementaritymodulating residues," *Protein Engineering.*, 7:805-814 (1994).
Szybalska, E. et al. "Genetics of Human Cell Lines, Iv. Dna-Mediated Heritable Transformation of a Biochemical Trait," *Proc. N. A. S.*, 2026 (1962).
Tan, P. et al. ""Superhumanized" Antibodies: Reduction of Immunogenic Potential by Complementarity-Determining Region Graft-

(56) References Cited

OTHER PUBLICATIONS ing with Human Germline Sequences: Application to an Anti-CD28," *J Immunol* 169:1119-1125 (2017).

Thorpe, P. et al. "The Preparation and Cytotoxic Properties of Antibody-Toxin Conjugates," *Immunological Rev.*, 62 (1982).

Tolstoshev, P. "Gene Therapy, Concepts, Current Trials and Future Directions," *Annu. Rev. Pharmacol. Toxicol.*, 32:573-96 (1993).

Traunecker, A. et al. "Soluble CD4 molecules neutralize human immunodeficiency virus type 1," *Nature.*, 331: 84-86 (1988).

Van Heeke, G. et al. "Expression of Human Asparagine Synthetase in *Escherichia coli*," *The Journal of Biological Chemistry.*, 264:5503-5509 (1989).

Vie, H. et al. "Human fusion proteins between interleukin 2 and IgM heavy chain are cytotoxic for cells expressing the interleukin 2 receptor," *Proc. Natl. Acad. Sci. USA.*, 89:11337-11341 (1992).

Wall, N. et al. "Modulation of cIAP-1 by Novel Antitubulin Agents When Combined with Bryostatin 1 Results in Increased Apoptosis in the Human Early Pre-B Acute Lymphoblastic Leukemia Cell Line Reh," *Biochemical and Biophysical Research Communications.*, 266:76-80 (1999).

Wang, L. et al. "VISTA, a novel mouse Ig superfamily ligand that negatively regulates T cell responses," *The Journal of Experimental Medicine.*, 208:577-592 (2011).

Wigler, M. et al. "Transformation of mammalian cells with an amplifiable dominant-acting gene," *Proc. Natl. Acad. Sci. USA.*, 77:3567-3570 (1980).

Wigler, M. et al. "Transfer of Purified Herpes Virus Thymidine Kinase Gene to Cultured Mouse Cells," *Cell.*, 11:223-232 (1977).

Wilson, I. et al. "The Structure of an Antigenic Determinant in a Protein," *Cell.*, 37:767-778 (1984).

Woyke, T. et al. "In Vitro Activities and Postantifungal Effects of the Potent Dolastatin 10 Derivative Auristatin PHE." *Antimicrobial Agents and Chemotherapy.*, 45:3580-3584 (2001).

Woyke, T. et al. "Effect of Auristatin PHE on Microtubule Integrity and Nuclear Localization in Cryptococcus neoformans," *Antimicrobial Agents and Chemotherapy.*, 46:3802-3808 (2002).

Wu, G. et al. "Receptor-mediated in Vitro Gene Transformation by a Soluble DNA Carrier System," *The Journal of Biological Chemistry.*, 262:4429-4432 (1987).

Wu, G. et al. "Delivery systems for gene therapy," *Biotherapy.*, 3:87-95 (1991).

Yates, J. et al. "Proteomics by Mass Spectrometry: Approaches, Advances, and Applications," *Annu. Rev. Biomed. Eng.*, 11:49-79 (2009).

Zhang, Z. et al. "Signal peptide prediction based on analysis of experimentally verified cleavage sites," *Protein Science.*, 13:2819-2824 (2004).

Zheng, X. et al. "Administration of noncytolytic IL-10/Fc in murine models of lipopolysaccharide-induced septic shock and allogeneic islet transplantation," *The Journal of Immunology.*, 154:5590-5600 (1995).

Zimmermann, K. et al. "A Triglycine Linker Improves Tumor Uptake and Biodistributions of 67-Cu-Labeled Anti-Neuroblastoma MAb chCE7 F(ab')$_2$ Fragments," *Nuclear Medicine & Biology.*, 26:943-950 (2000).

Zybailov, B. et al. "Statistical Analysis of Membrane Proteome Expression Changes in *Saccharomyces cerevisiae*," *Journal of Proteome Research.*, 5:2339-2347 (2006).

\* cited by examiner

| C10ORF54 | CD13+/CD33+ | | | CD34+/CD33+ | | | CD34+/CD33− | | |
|---|---|---|---|---|---|---|---|---|---|
| | Incidence* | Pos, [%] | Fold MFI | Incidence* | Pos, [%] | Fold MFI | Incidence* | Pos, [%] | Fold MFI |
| AML | 18/23 (3 relapses) | 31 | 48.6 | 10/21 (3 relapses) | 41 | 50.9 | 9/21 (3 relapses) | 25 | 8.5 |
| BMNC | 3/3 | 75 | 28.1 | 1/3 | 31 | 0.9 | 0/3 | 1.5 | 0.5 |

FIG. 2 huVH1
Potential humanized sequence based on IMGT IGHV1-18 acceptor framework (method 1)
QVQLVQSGAEVKKPGASVKVSCKAS GYTFTSYGIS WVRQAPGQGLEWMG WISAYNGNTNYAQKLQG RVTMTIDTSTSTAYMELRSLRSDDTAVYYCAR Joining region
IMGT J00256|IGHJ4*01|YFDYWGQTLVTVSS

```
seq          10         20         30         40         50         60         70         80         90
         b b b      b b b b     b b   b b    b  i i   i b b     b    b b b   i    b b b      b b b b    b  b i b
76E1   EVQLLQSGPELEKPGASVKISCKAS GYSFTGYNMN WVKQSNGKSLEWIG NIDPYYDYTSYNLKFKD KAILTVDKSSSTAYMQLKSLTSEDSAVYYCAT
        *  *  ***                 * ****  *       * *                     * * **  *  *   *  *       * huVH1a QVQLVQSGAEVKKPGASVKVSCKAS GYSFTGYNMN WVRQAPGQGLEWMG NIDPYYDYTSYNLKFKD RVTMTIDTSTSTAYMELRSLRSDDTAVYYCAR
                             I                  Q                           A L Y K              I
                                                S
                                                D
                                                A
```

```
AbM                                                     S I E      Q                 A L Y K
huVH1b QVQLVQSGAEVKKPGASVKVSCKAS GYSFTGYNMN WVRQAPGQGLEWMG NIDPYYDYTSYAQKLQG RVTMTIDTSTSTAYMELRSLRSDDTAVYYCAR
                             I                  S I E      S                 F       A L Y K              I
                                                  S        D
                                                  D        A
                                                  A
```

```
seq         100       110
         i b   i b b b
76E1   STMITPFDY WGQGTTLTVSS
          * *
huVH1a STMITPFDY WGQGTLVTVSS
        L                      100a       110
        L
AbM    STMITPFDY WGQGTLVTVSS
huVH1b STMITPFDY WGQGTLVTVSS
        L
```

(1) CDR sequences noted in bold.
(2) Human germline and joining sequences from IMGT® the international ImMunoGeneTics information system®
    www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterisk (*).
(6) Potential humanized framework mutations from human sequence to parental mouse sequence are noted
    below sequence in red; underlined residues are positions to alter first.
(7) Potential changes in CDR sequence noted below each CDR sequence. These may prevent asparagines
    (N) deamidation (N), methionine (M) oxidation, Asp-Gly (DG) isoaspartate formation or Asp-Pro (DP) bond cleavage.

FIG. 3A huVH3
Potential humanized sequence based on IMGT IGHV3-48 acceptor framework (method 2)
EVQLVESGGGLVQPGGSLRLSCAAS GFTFSSYSMN WVRQAPGKGLEWVS YISSSSSTIYYADSVKG RFTISRDNAKNSLYLQMNSLRAEDTAVYYCAR Joining region
IMGT J00256|IGHJ4*01|YFDYWGQGTLVTVSS

```
seq            b b b           b b b b          b b          b b i    i b b b             i    b           b b b      b b b b      b    b b i b
                         10             20             30             40             50             60             70             80             90
76E1    EVQLLQSGPELEKPGASVKISCKAS GYSFTGYNMN WVKQSNGKSLEWIG NIDPYYDYTSYNLKFKD KATLTVDKSSSTAYMQLKSLTSEDSAVYYCAT
          ** * ***           * ****  *                   * ****** *        * **** *        ***   * huVH3a  EVQLVESGGGLVQPGGSLRLSCAAS GYSFTGYNMN WVRQAPGKGLEWVS NIDPYYDYTSYNLKFKD RFTISRDNAKNSLYLQMNSLRAEDTAVYYCAR
                          Q                               S  IG         E    Q                        A  L  Y  K  S  A  M  L
                          V  I                            S            S
                                                          D            D
                                                          A            A
```

```
AbM            ib        b b  b b          b b        b  b i      i b b b                b         b b        b b b     b b b b   b b i b
                      10             20             30             40             50 a           60             70 abc           80             90
huVH3b  EVQLVESGGGLVQPGGSLRLSCAAS GYSFTGYNMN WVRQAPGKGLEWVS NIDPYYDYTSYADSVKG RFTISRDNAKNSLYLQMNSLRAEDTAVYYCAR     I
                                                          S  IG         E    Q                    F                       A  L  V  K  S  A  M  L
                                                                         S            S
                                                                         D            A
                                                                         A
```

```
seq      100          110
             ib    i     b b b
76E1    STMITPFDY  WGQGTLVTVSS
                   *  * huVH3a  STMITPFDY  WGQGTLVTVSS
                L           L

AbM     100a      110
huVH3b  STMITPFDY  WGQGTLVTVSS
                L
```

FIG. 3B (1) CDR sequences noted in bold.
(2) Human germline and joining sequences from IMGT® the international ImMunoGeneTics information system® www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterisk (*).
(6) Potential humanized framework mutations from human sequence to parental mouse sequence are noted below sequence in red; underlined residues are positions to alter first.
(7) Potential changes in CDR sequence noted below each CDR sequence. These may prevent asparagines (N) deamidation (N), methionine (M) oxidation, Asp-Gly (DG) isoaspartate formation or Asp-Pro (DP) bond cleavage.

FIG. 4A huVH1
Potential humanized sequence based on IMGT IGHV1-18 acceptor framework (method 1)
QVQLVQSGAEVKKPGASVKVSCKAS GYTFTSYGIS WVRQAPGQGLEWMG WISAYNGNTNYAQKLQG RVTMTDTSTSTAYMELRSLRSDDTAVYYCAR Joining region
IMGT 00256|IGHJ4*01|YFDYWGQGTLVTVSS

```
seq           10         20         30         40         50         60         70         80         90
              bbb        bbbb       bb  b  bii    ibb bb    i   b        bbb       bbbb b   b bib
141A    QVQLQQSGAELMKPGASVKISCKAT GYTFSRYWIE WKQRPGHGLEWIG EILPGSGSTNYNEKFKG KATFTADTSSNTAYMQLSSLTSEDSAVYYCAG
              *          **     *      *     **       **        *  **      ****          *   ****  *       *
huVH1a  QVQLVQSGAEVKKPGASVKVSCKAS GYTFSRYWIE WVRQAPGQGLEWMG EILPGSGSTNYNEKFKG RVTMTDTSTSTAYMELRSLRSDDTAVYYCAR
                M        I                        I         Q Q            A F A      N
                                                            S S            
                                                            D D            
                                                            A A            
AbM           10         20         30         40         50  a       60         70  abc     80         90
huVH1b  QVQLVQSGAEVKKPGASVKVSCKAS GYTFSRYWIE WVRQAPGQGLEWMG EILPGSGSTNYAQKLQG RVTMTDTSTSTAYMELRSLRSDDTAVYYCAR
                M        I                        I         Q     F    A F A      N
                                                            S          S
                                                            D          D
                                                            A          A seq   100        110        120
          ib  i  b b b
141A  EEVYDGYPWFGY WGQGTLVTVSA
                    *
huVH1a EEVYDGYPWFGY WGQGTLVTVSS
         E
         S
         A
AbM   100abcd      110
huVH1b EEVYDGYPWFGY WGQGTLVTVSS
         E
         S
         A
```

(1) CDR sequences noted in bold.
(2) Human germline and joining sequences from IMGT® the international ImMunoGeneTics information system® www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted below sequence in red; underlined residues are positions to alter first.
(7) Potential changes in CDR sequence noted below each CDR sequence. These may prevent asparagines (N) deamidation (N), methionine (M) oxidation, Asp-Gly (DG) isoaspartate formation or Asp-Pro (DP) bond cleavage.

FIG. 4B huVH3
Potential humanized sequence based on IMGT IGHV3-48 acceptor framework (method 2)
EVQLVESGGGLVQPGGSLRLSCAAS GFTFSSYSMN WVRQAPGKGLEWVS YISSSSSTIYYADSVKG RFTISRDNAKNSLYLQMNSLRAEDTAVYYCAR Joining region
IMGT J00256|IGHJ4*01|YFDYWGQGTLVTVSS

```
seq            10         20            30          40         50          60          70         80         90
             b b b      b b b b      b b  b  b i i   i b b  b b           i  b           b b b      b b b b   b  b i b
141A  QVQLQQSGAELMKPGASVKISCKAT GYTFSRYWIE WKQRPGHGLEWIG EILPGSGSTNYNEKFKG KATFTADTSSNTAYMQLSSLSEDSAVYYCAG
        *   **   * ** * ****  *  *                           *           *  *   *   ** *  * huVH3a EVQLVESGGGLVQPGGSLRLSCAAS GYTFSRYWIE WVRQAPGKGLEWVS EILPGSSGSTNYNEKFKG RFTISRDNAKNSLYLQMNSLRAEDTAVYYCAR
                             Q   M    V I                 IG              QQ          AFAI       AML          G
                                                                          SS
                                                                          DD
                                                                          AA
AbM                                                                       S         F  AFAI       AML          G
huVH3b EVQLVESGGGLVQPGGSLRLSCAAS GYTFSRYWIE WVRQAPGKGLEWVS EILPGSSGSTNYADSVKG RFTISRDNAKNSLYLQMNSLRAEDTAVYYCAR
                                                                          D                       AML
                                                                          A seq    100           110           120
                ib  i    b b b
141A   EEVYDGYPWFGY WGQGTLVTVSA
                                      *
huVH3a EEVYDGYPWFGY WGQGTLVTVSS
        E
        S
        A
AbM    100abcd       110
huVH3b EEVYDGYPWFGY WGQGTLVTVSS
        E
        S
        A
```

(1) CDR sequences noted in bold.
(2) Human germline and joining sequences from IMGT® the international ImMunoGeneTics information system® www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted below sequence in red; underlined residues are positions to alter first.
(7) Potential changes in CDR sequence noted below each CDR sequence. These may prevent asparagines (N) deamidation (N), methionine (M) oxidation, Asp-Gly (DG) isoaspartate formation or Asp-Pro (DP) bond cleavage.

huVH1
Potential humanized sequence based on IMGT IGHV1-18 acceptor framework (method 1)
QVQLVQSGAEVKKPGASVKCKAS GYTFTSYGIS WVRQAPGQGLEWMG WISAYNGNTNYAQKLQG RVTMTTDTSTSTAYMELRSLRSDDTAVYYCAR Joining region
IMGT J00256|IGHJ4*01|YFDYWGQTLVTVSS

```
seq             10          20            30         40           50         60           70        80         90
          b    b  b b b      b b b b    b   b i i   i bb  b b      i  b   b b b      b b b b  b  b i b
175A   QVQLQQSGAELMKPGASVKISCKAT GYTFSTHWIE WKQRPGHGLEWIG EILPGSGSTSYNEKFKG KATFTADTSSNTAYMQLSSLTSEDSAVYYCAR
          *    **                *          *           *    *                ** ** **   ** *   ** *   *
huVH1a QVQLVQSGAEVKKPGASVKVSCKAS GYTFSTHWIE WVRQAPGQGLEWMG EILPGSGSTSYNEKFKG RVTMTTDTSTSTAYMELRSLRSDDTAVYYCAR
                            i                                i                Q            A F A
                                                                              S
                                                                              D
                                                                              A
AbM                                                                                               F
huVH1b QVQLVQSGAEVKKPGASVKVSCKAS GYTFSTHWIE WVRQAPGQGLEWMG EILPGSGSTSYAQKLQG RVTMTTDTSTSTAYMELRSLRSDDTAVYYCAR
                            I                                                                 AFA
          10          20           30          40          50 a        60           70 abc      80        90 seq     100         110
        ib  i    b b b
175A   WLLYYYAMDY WGQGTSVTVSS
            *
huVH1a WLLYYYAMDY WGQGTLVTVSS AbM    100ab    110
huVH1b WLLYYYAMDY WGQGTLVTVSS
        100         110
```

(1) CDR sequences noted in bold.
(2) Human germline and joining sequences from IMGT® the International ImMunoGeneTics information system®
    www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted
    below sequence in red; underlined residues are positions to alter first.
(7) Potential changes in CDR sequence noted below each CDR sequence. These may prevent asparagines
    (N) deamidation (N), methionine (M) oxidation, Asp-Gly (DG) isoaspartate formation or Asp-Pro (DP) bond cleavage.

FIG. 5A huVH3
Potential humanized sequence based on IMGT IGHV3-48 acceptor framework (method 2)
EVQLVESGGGLVQPGGSLRLSCAAS GFTFSSYSMN WVRQAPGKGLEWVS YISSSSSTIYYADSVKG RFTISRDNAKNSLYLQMNSLRAEDTAVYYCAR Joining region
IMGT J00256|IGHJ4*01|YFDYWGQTLVTVSS

```
seq             10            20            30             40              50                60              70           80           90
          b b b         b b b b        b b     b b i i       i b b b         i     b         b b b         b b b b b   b b b
175A    QVQLQQSGAELMKPGASVKISCKAT GYTFSTHWIE WVKQRPGHGLEWIG EILPGSGSTSYNEKFKG KATFTADTSSNTAYMQLSSLTSEDSAVYYCAR
          *   ** ****  * ****  * ** *    **    *     **  *       **     **  ** **** *** *** **   * **  *    *
                    Q                   V I                                  IG                          Q        AFAI  A M L
                                                                                                         S
                                                                                                         D
                                                                                                         A
huVH3a  EVQLVESGGGLVQPGGSLRLSCAAS GYTFSTHWIE WVRQAPGKGLEWVS EILPGSGSTSYNEKFKG RFTISRDNAKNSLYLQMNSLRAEDTAVYYCAR
                    Q                   V I                                  IG                                   AFAI  A M L AbM             10            20            30             40              50   a            60   abc       70   abc       80          90
          i b           b b b                                                                              b b b
huVH3b  EVQLVESGGGLVQPGGSLRLSCAAS GYTFSTHWIE WVRQAPGKGLEWVS EILPGSGSTSYADSVKG RFTISRDNAKNSLYLQMNSLRAEDTAVYYCAR
                                                                             F                              AFAI  A M L seq            100           110
          ib    i       b b b
175A    WLLYYYAMDY WGQGTSVTVSS
               *
huVH3a  WLLYYYAMDY WGQGTLVTVSS AbM           100ab         110
huVH3b  WLLYYYAMDY WGQGTLVTVSS
```

(1) CDR sequences noted in bold.
(2) Human germline and joining sequences from IMGT® the international ImMunoGeneTics information system® (www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted below sequence in red; underlined residues are positions to alter first.
(7) Potential changes in CDR sequence noted below each CDR sequence. These may prevent asparagines (N) deamidation (N), methionine (M) oxidation, Asp-Gly (DG) isoaspartate formation or Asp-Pro (DP) bond cleavage.

FIG. 5B huVK2
Potential humanized sequence based on IMGT IGKV2-28 acceptor framework (method 1)
DIVMTQSPLSLPVTPGEPASISC RSSQSLLHSNGYNYLD WYLQKPGQSPQLLIY LGSNRAS GVPDRFSGSGSGTDFTLKISRVEAEDVGVYYC MQALQTP Joining region
IMGT J00242|IGKJ2*01|YTFGQGTKLEIK

```
                    10         20             30          40          50        60         70         80        90
seq                 10         20             30abcde     40          50        60         70         80        90
AbM        b  b   b   b   b     b   b     b   bi b i     ii ibbi    i  b     b     b b b  b    bb bib
76E1    DVLMTQTPLSLPVSLGDQASISC RSSQSIVHSNGNTYLE  WYLQKPGQSPKLLIY KVSNRFS GVPDRFSGSGSGTDFTLKINRVEAEDLGVYYC
               *  **      **                   *                                     *         *
                                               Q Q                                                   L
                                               S S
                                               A A
                                               D huVK2   DIVMTQSPLSLPVTPGEPASISC RSSQSIVHSNGNTYLE  WYLQKPGQSPQLLIY KVSNRFS GVPDRFSGSGSGTDFTLKISRVEAEDVGVYYC
           V                                                      Q
                                                                  S
                                                                  D
                                                                  A 90         100        110
seq                 90         100        110
AbM        ibi    iib i       b b b
76E1    FQGSHVPWT FGGGTKLEIK
              *
huVK2   FQQSHVPWT FGQGTKLEIK
```

(1) CDR sequences noted in bold.
(2) Human germline and joining sequences from IMGT® the international ImMunoGeneTics information system® www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain, "i" notes sidechain at interface between VH and VL domains.
(5) Sequence differences between each humanized sequence and murine sequence noted by asterick (*).
(6) Potential humanized framework mutations from human sequence to parental mouse sequence are noted below sequence in red; underlined residues are positions to alter first.
(7) Potential changes in CDR sequence noted below each CDR sequence. These may prevent asparagines (N) deamidation (N), methionine (M) oxidation, Asp-Gly (DG) isoaspartate formation or Asp-Pro (DP) bond cleavage.

FIG. 6A huVK1
Potential humanized sequence based on IMGT IGKV1-39 acceptor framework (method 2)
DIQMTQSPSSLSASVGDRVTITC RASQSISSYLN WYQQKPGKAPKLLIY AASSLQS GVPSRFSGSGSGTDFTLTISSLQPEDFATYYC QQSYSTP

Joining region
IMGT J00242|IGKJ2*01|YTFGQGTKLEIK

```
seq           10         20         30          40         50         60         70         80         90
AbM           10         20       30abcde       40         50         60         70         80         90
              b b   b b b    b       bi bi i  ii ibbi       i  b  b        b b b   b   bb bib
76E1 DVLMTQTPLSLPVSLGDQASISC RSSQSIVHSNGNTYLE WYLQKPGQSPKLLIY KVSNRFS GVPDRFSGSGSGTDFTLKINRVEAEDLGVYYC
       ** *** b b b  *** **                 **                     *                 * ******  ***
                     V A                                                                         V  LG
                                                             Q
                                                             S
                                                             D
                                                             A
huVK1 DIQMTQSPSSLSASVGDRVTITC RSSQSIVHSNGNTYLE WYQQKPGKAPKLLIY KVSNRFS GVPSRFSGSGSGTDFTLTISSLQPEDFATYYC
                              Q Q                S
                              S S
                              A A
                              D
```

```
seq     90        100       110
AbM     90        100       110
         ibi   iib i   b b b
76E1 FQQSHVPWT FGGGTKLEIK
                *
huVK1 FQQSHVPWT FGQGTKLEIK
```

(1) CDR sequences noted in bold.
(2) Human germline and joining sequences from IMGT® the international ImMunoGeneTics information system®
    www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted
    below sequence in red; underlined residues are positions to alter first.
(7) Potential changes in CDR sequence noted below each CDR sequence. These may prevent asparagines
    (N) deamidation (N), methionine (M) oxidation, Asp-Gly (DG) isoaspartate formation or Asp-Pro (DP) bond cleavage.

FIG. 6B huVK3
Potential humanized sequence based on IMGT IGKV3-20 acceptor framework (method 1)
EIVLTQSPGTLSLSPGERATLSC RASQSVSSSYLA WYQQKPGQAPRLLIY GASSRAT GIPDRFSGSGSGTDFTLTISRLEPEDFAVYYC QQYGSSP

Joining region
IMGT J00242|IGKJ2*01|YTFGQGTKLEIK

```
               10          20         30        40        50         60        70         80
seq            10          20         34        40        50         60        70         80
AbM    b b b   b      b   b b b    b b i i   ii ibbi     i    b    b    b b b    b    b bib
141A   QIVLSQSPAILSASPGEKVTMTC RASSSLSYMH WYQQKPGSSPKPWIY ATSNLAS GVPARFSGSGSGTSYSLTISRVEAEDAATYYC
        *        **      *       ****       **  ***      *****                 ***         **  *
huVK3  EIVLTQSPGTLSLSPGERATLSC RASSSLSYMH WYQQKPGQAPRLLIY ATSNLAS GIPDRFSGSGSGTDFTLTISRLEPEDFAVYYC
                      A        V M                  S  PW        Q             V              Y          V
                                                    S             S                            Y          V
                                                                  D
                                                                  A
```

```
         90          100
seq      90          100
AbM    ibi  iib i   b b b
141A   QQWSSNPYT FGQGTKLEIK
              *
huVK3  QQWSSNPYT FGQGTKLEIK
       Q
       S
       A
```

(1) CDR sequences noted in bold.
(2) Human germline and joining sequences from IMGT® the international ImMunoGeneTics information system®
   www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted
   below sequence in red; underlined residues are positions to alter first.
(7) Potential changes in CDR sequence noted below each CDR sequence. These may prevent asparagines
   (N) deamidation (N), methionine (M) oxidation, Asp-Gly (DG) isoaspartate formation or Asp-Pro (DP) bond cleavage.

FIG. 7A huVK1
Potential humanized sequence based on IMGT IGKV1-39 acceptor framework (method 2)
DIQMTQSPSSLSASVGDRVTITC RASQSISSYLN WYQQKPGKAPKLLIY AASSLQS GVPSRFSGSGSGTDFTLTISSLQPEDFATYYC QQSYSTP

Joining region
IMGT J00242|IGKJ2*01|YTFGQGTKLEIK

```
              10          20         30         40         50          60         70         80
seq           10          20         34         40         50          60         70         80
AbM       b   b  b      b b  b    b bi b i i   ii ibbi   i    b       b b    bbb  b b    b bib
141A      QIVLSQSPAILSASPGEKVTMTC RASSSLSYMH WYQQKPQSSPKPWIY ATSNLAS GVPARFSGSGSGTSYSLTISRVEAEDAAIYYC
          *   **    **   * ***  *           **     **         **                    *    ****  *
huVK1     DIQMTQSPSSLSASVGDRVTITC RASSSLSYMH WYQQKPGKAPKLLIY ATSNLAS GVPSRFSGSGSGTDFTLTISSLQPEDFATYYC
              L                        M       S  PW          Q                             Y
                                                              S                             V
                                                              D
                                                              A
```

```
              90         100
seq           90         100
AbM       ibi     iib i     b  b  b
141A      QQWSSNPYT FGGGTKLEIK
                  *
huVK1     QQWSSNPYT FGQGTKLEIK
              Q
              S
              A
```

FIG. 7B (1) CDR sequences noted in bold.
(2) Human germline and joining sequences from IMGT® the international ImMunoGeneTics information system®
    www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted
    below sequence in red; underlined residues are positions to alter first.
(7) Potential changes in CDR sequence noted below each CDR sequence. These may prevent asparagines
    (N) deamidation (N), methionine (M) oxidation, Asp-Gly (DG) isoaspartate formation or Asp-Pro (DP) bond cleavage.

huVK2
Potential humanized sequence based on IMGT IGKV2-28 acceptor framework (method 1)
DIVMTQSPLSLPVTPGEPASISC RSSQSLLHSNGYNYLD WYLQKPGQSPQLLIY LGSNRAS GVPDRFSGSGSGTDFTLKISRVEAEDVGVYYC MQALQTP Joining region
IMGT J00242|IGKJ2*01|YTFGQGTKLEIK

```
              10         20         30            40         50         60         70         80         90
seq           10         20         30abcde       40         50         60         70         80
AbM      b b   b  b    bbb  b      bi bii  ii ibbi       i     b b    bbb  b   bb bib
175A   DVLMTQTPLSLPVSLGDQASISC RSSQSIVHSNGNTYLE WYLQKPGQSPKLLIY KLSNRFS GVPDRFSGSGSGTDFTLKISRVEAEDLGVYYC
         **   **                 *                          *                                     *
                                Q Q                         Q                                     L
                                S S                         S
                                A A                         D
                                D                           A
huVK2  DIVMTQSPLSLPVTPGEPASISC RSSQSIVHSNGNTYLE WYLQKPGQSPQLLIY KLSNRFS GVPDRFSGSGSGTDFTLKISRVEAEDVGVYYC 90        100        110
seq           90        100
AbM      ibi    iib i    b b b
175A    FQQSHFPYT FGGGTKLEIK
              *
huVK2   FQQSHFPYT FGQGTKLEIK
```

(1) CDR sequences noted in bold.
(2) Human germline and joining sequences from IMGT® the international ImMunoGeneTics information system®
    www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterick (*).
(6) Potential humanized framework mutations from human sequence to parental mouse sequence are noted
    below sequence in red; underlined residues are positions to alter first.
(7) Potential changes in CDR sequence noted below each CDR sequence. These may prevent asparagines
    (N) deamidation (N), methionine (M) oxidation, Asp-Gly (DG) isoaspartate formation or Asp-Pro (DP) bond cleavage.

FIG. 8A huVK1
Potential humanized sequence based on IMGT IGKV1-39 acceptor framework (method 2)
DIQMTQSPSSLSASVGDRVTITC RASQSISSYLN WYQQKPGKAPKLLIY AASSLQS GVPSRFSGSGSGTDFTLTISSLQPEDFATYYC QQSYSTP Joining region
IMGT J00242|IGKJ2*01|YTFGQGTKLEIK

```
             10           20          30           40          50           60          70          80          90
seq          10           20        30abcde         40          50           60          70          80
AbM  ibi   iib  i  b b b    b   bi bi i   ii ibbi   i    b   b      b     bbb  b    bb bib
175A DVLMTQTPLSLPVSLGDQASISC RSSQSIVHSNGNTYLE WYLQKPGQSPKLLIY KLSNRFS GVPDRFSGSGSGTDFTLKISRVEAEDLGVYYC
      **   ***  *** *** *     * ***           **              *                 *    ****          ***
huVK1 DIQMTQSPSSLSASVGDRVTITC RSSQSIVHSNGNTYLE WYQQKPGKAPKLLIY KLSNRFS GVPSRFSGSGSGTDFTLTISSLQPEDFATYYC
                      V                  Q         S            Q                                  V   LG
                      A                  S         A            S
                                         A         D            D
                                         D                      A 90           100         110
seq          90           100
AbM   ibi    iib  i   b b b
175A  FQGSHFPYT FGGGTKLEIK
             *
huVK1 FQGSHFPYT FGGGTKLEIK
```

(1) CDR sequences noted in bold.
(2) Human germline and joining sequences from IMGT® the International ImMunoGeneTics information system®
    www.imgt.org (founder and director: Marie-Paule Lefranc, Montpellier, France).
(3) Residue numbering shown as sequential (seq) or according to website www.bioinf.org.uk/abs/ (AbM).
(4) "b" notes buried sidechain; "i" notes sidechain at interface between VH and VL domains.
(5) Sequence differences between each humanized sequence and murine sequence noted by asterisk (*).
(6) Potential humanized framework mutations from human sequence to parental mouse sequence are noted
    below sequence in red; underlined residues are positions to alter first.
(7) Potential changes in CDR sequence noted below each CDR sequence. These may prevent asparagines
    (N) deamidation (N), methionine (M) oxidation, Asp-Gly (DG) isoaspartate formation or Asp-Pro (DP) bond cleavage.

FIG. 8B

76E1 VH
EVQLLQSGPELEKPGASVKISCKASGYSFAAAAAAAAAAWVQSNGKSLEWIGAIAAAAAAAAAAAAAAAAAAAAKATLTVDKSSSTAYMQLKSLTSEDSAVYYC
ATAAAAAAAFDYWGQGTTLTVSS (SEQ ID NO: 1143)
human subgroup I 141A VH
QVQLQQSGAELMKPGASVKISCKATGYTFAAAAAAAAAAWVKQRPGHGLEWIGAIAAAAAAAAAAAAAAAAAAAAKATFTADTSSNTAYMQLSSLTSEDSAVYYC
AGAAAAAAAAAAAWGQGTLVTVSA (SEQ ID NO: 1144)
human subgroup I 175A VH
QVQLQQSGAELMKPGASVKISCKATGYTFAAAAAAAAAAWVKQRPGHGLEWIGAIAAAAAAAAAAAAAAAAAAAAKATFTADTSSNTAYMQLSSLTSEDSAVYYC
ARAAAAAYAMDYWGQGTSVTVSS (SEQ ID NO: 1145)
human subgroup I 76E1 VL
DVLMTQTPLSLPVSLGDQASISCRSSQSAAAAAAAAAAAWYLQKPGQSPKLLIYAAAAAAAAGVPDRFSGSGSGTDFTLKINRVEAEDLGVYYCAQA
AAAPATFGGGTKLEIK (SEQ ID NO: 1146)
human kappa II 141A VL
QIVLSQSPAILSASPGEKVTMTCRASAAAAAAAAAAWYQQKPGSSPKPWIYAAANLASGVPARFSGSGSGTSYSLTISRVEAEDAATYCQQAAAAPAT
FGGGTKLEIK (SEQ ID NO: 1147)
human kappa III 175A VL
DVLMTQTPLSLPVSLGDQASISCRSSQSAAAAAAAAAAAWYLQKPGQSPKLLIYAAAAAAAAGVPDRFSGSGSGTDFTLKISRVEAEDLGVYYCAQA
AAAPATFGGGTKLEIK (SEQ ID NO: 1148)
human kappa II

R13-3610-76E1    MGWTWIFILILSVTTGVHS
R13-3610-141A    MEWTWVFLFLLSVTAGVHS
R13-3610-175A    MEWTWVFLFLLSVTAGVHS

```
                                                                                31——35           50—a——60——65
Kabat    1              10              22                              26——35               50—a——60    65
AbM      1              10              22                              26——32               50—a——58    65
Chothia  1              10              22                      30——35                           a——55    65
Contact  1              10              22              27——38                      47       56——65      74
IMGT     1              10              23                  41
76E1     EVQLLQSGPELEKPGASVKISCKAS GYSFTGYNMN WVKQSNGKSLEWIG NIDPYYDYTSYNLKFKD
141A     QVQLQQSGAELMKPGASVKISCKAT GYTFSRYWIE WVKQRPGHGLEWIG EILPGSGSTNYNEKFKG
175A     QVQLQQSGAELMKPGASVKISCKAT GYTFSTHWIE WVKQRPGHGLEWIG EILPGSGSTSYNEKFKG 95——100——102
Kabat    70             80      abc     90      95——100——102                110
AbM      70             80      abc     90      96——100——101                110
Chothia  70             80      abc     90          100——101                110
Contact  70             80      abc     90  93——                            110
IMGT         75                     89      105——————117
76E1     KATLTVDKSSSTAYMQLKSLTSEDSAVYYCAT SIMITP——FDY WGQGTLLTVSS
141A     KATFTADTSSNTAYMQLSSLTSEDSAVYYCAG EEVDGYPWFGY WGQGTLVTVSA
175A     KATFTADTSSNTAYMQLSSLTSEDSAVYYCAR WLLYYA——MDY WGQGTSVTVSS
```

```
       1             10          22   26——————35        40           50—q———58        65
AbM                                                                   ————q
hu76E1 QVQLVQSGAEVKKPGASVKVSCKAS GYSFTGYNMN WVRQAPGQGLEWIG NIDPYDYTSYNLKFKD hu141A QVQLVQSCAEVKKPGASVKVSCKAS GYTFSRYWIE WVRQAPGQGLEWIG EILPGSGSTNYNEKFKG
hu175A QVQLVQSCAEVKKPGASVKVSCKAS GYTFSTHWIE WVRQAPGQGLEWIG EILPGSGSTSYNEKFKG
consen QVQLVQSGAEVKKPGASVKVSCKAS GYTFSXXWIE WVRQAPGQGLEWIG EILPGSGSTXYNEKFKG
                                    RY                                N
                                    TH                                S 70     80 abc        90              95—100——102
AbM
hu76E1 RVTMTVDKSTSTAYMELRSLRSDDTAVYYCAT STMITP——FDY WGQGTLVTVSS (SEQ ID NO: 1135)

hu141A RVTMTADTSTSTAYMELRSLRSDDTAVYYCAG EEVYDGYPWFGY WGQGTLVTVSS (SEQ ID NO: 1136)
hu175A RVTMTADTSTSTAYMELRSLRSDDTAVYYCAR WLYYYA—NDY WGQGTLVTVSS (SEQ ID NO: 1137)
consen RVTMTADTSTSTAYMELRSLRSDDTAVYYCAR xxxxxxxxxXXY WGQGTLVTVSS (SEQ ID NO: 1138)
                                      WG
                                      FD
```

FIG. 17A

```
R13 VL 1           10          20      24————30abcd————34         40          50————56
AbM      EIVLTQSPGTLSLSPGERATLSC RASSSL————SYMH WYQQKPGQAPRPWIY ATSNLAS
hu141A hu76E1   DIVMTQSPLSLPVTPGEPASISC RSSQSIVHSNGNTYLE WYLQKPGQSPQLLIY KVSNRFS
hu175A   DIVMTQSPLSLPVTPGEPASISC RSSQSIVHSNGNTYLE WYLQKPGQSPQLLIY KLSNRFS
consen   DIVMTQSPLSLPVTPGEPASISC RSSQSIVHSNGNTYLE WYLQKPGQSPQLLIY KXSNRFS
                                                                   V
                                                                   L 60          70          80           89————97
AbM      GIPDRFSGSGSGTDYTLTISRLEPEDFAVYYC QQWSSNPYT FGQGTKLEIK
hu141A hu76E1   GVPDRFSGSGSGTDFTLKISRVEAEDVGVYYC FQGSHVPWT FGQGTKLEIK (SEQ ID NO: 1139)
hu175A   GVPDRFSGSGSGTDFTLKISRVEAEDVGVYYC FQGSHFPYT FGQGTKLEIK (SEQ ID NO: 1140)
hu76E1   GVPDRFSGSGSGTDFTLKISRVEAEDVGVYYC FQGSHFPYT FGQGTKLEIK (SEQ ID NO: 1141)
consen   GVPDRFSGSGSGTDFTLKISRVEAEDVGVYYC FQGSHXPXT FGQGTKLEIK (SEQ ID NO: 1142)
                                              V W
                                              F Y
```

```
VH Domains
AbM#        10         20         26  30        35         40         50    a      65
5B     QVQLQQSGAELVRPGVSVKISCKGS GYTFFTD-YGMH WVKQSHAKSLEWIG IIDTYYGDATYNQKFKG
46A    QVQLQQAGGELVRPGVSVKISCKGS GYTFFTD-YGMH WVKQSHAKSLEWIG IINTYYGDATYNQKFKG
97A    QVQLQQSGAELVRPGVSVKISCKGS GYTFFTD-YGMH WVKQSHAKSLEWIG VIDTYYGDASNQKFKG
128A   QVQLQQSGAELVRPGVSVKISCKGS GYTFFTD-YGMH WVKQSHAKSLEWIG LIDTYYGDATYNHKFKG
146C   QVQLQQSGAELVRPGVSVKISCKGS GYTFFTD-YGMH WVKQSHAKSLEWIG LIDTYYGDATYNHKFKG
208A   QVQLQQSGAELVRPGVSVKISCKGS GYTFFTD-YGMH WVKQSHAKSLEWIG VIDTYYGDAGYNQKFKG
consensus                       GYTFFTD-YGMH                *I*TYYGDA**N*KFKG 215A   EVQLQQSGPELVKPGASMKISCKAS GFSFTG-YTMN WVKQSHGKNLEWIG LISPYNGGTSYNQKFKG
26A    EVQLQQSGPELVKPGASMKISCKAS GFSFTG-YTMN WVKQSHVKNLEWIG LISPYNGGTSYNQKFKG
164A   EVQLQQSGPELEKPGASVKISCKAS GYSFTG-YNMN WVKQSNGKSLEWIG NIDPYYGSASYNQKFKG
230A   EVQLQQSGPELEKPGASVKISCKAS GYSFTG-SNMN WVKQNNGKSLEWIG NIDPYYGYTTYNQKFKG
76E1   EVQLLQSGPELEKPGASVKISCKAS GYSFTG-YNMN WVKQSNGKSLEWIG NIDPYDYTSYNLKFKD
53A    EVQLQQSGPELVKPGASVKMSCKAS GYTFTS-YFMH WVKQKPGQGLEWIG YIYPYNDGKYNEKFKG
259A   EVQLQQSGPELVKPGASVKMSCKAS GYTFTS-YFMH WVKQKPGQGLEWIG YIYPYNDGKYNEKFKG
consensus                       GYTFTS-YFMH                YIYPYNDGKYNEKFKG 33A    QVQLQQSGAELMKPGASVKISCKAT GYTFSS-YWIE WVKQRPGHGLEWIG EILPGSGSTSYNEKFKG
39A    QVQLQQSGAELMKPGASVKISCKAT GYTFSS-NWIE WVKQRPGHGLEWIG EILPGSGSTSYNEKFKG
124A   QVQLQQSGAELMKPGASVKISCKAT GYTFSS-NWIE WVKQRPGHGLEWMG EILPGSGSTSYNEKFKG
175A   QVQLQQSGAELMKPGASVKISCKAT GYTFST-HWIE WVKQRPGHGLEWIG EILPGSGSTSYNEKFKG
321D   QVQLQQSGAAVKPGASVKISCKAT GYTFSS-HWIE WVKQRPGHGLEWIG EILPGSGSTDYNEKFKG
consensus                      GYTFS*-*WIE                EILPGSGST*YNEKFKG 141A   QVQLQQSGAELMKPGASVKISCKAT GYTFSR-YWIE WVKQRPGHGLEWIG EILPGSGSTNYNEKFKG
51A    QVQLQQSGAELMKPGASVKISCKAT GYTFSR-YWIE WVKQRPGHGLEWIG EILPGSGSTNYNEKFKG
consensus                      GYTFSR-YWIE                EILPGSGSTNYNEKFKG

353A   EVKLLESGGGLVQPGGSLKLSCAAS GFDFSR-YWMN WVRQAPGKGLEWIG EINPDSSTINYTPSLKD

305A   DVQLQESGPGLVKPSQSLSLTCSVT GYSITSGYYWN WIRQFPGNKLEWMG YIS-YDGSNNYNPSLKN
```

FIG. 18B

```
AbM#       70        80  abc    90           95   100      102     110
5B    KATMTVDKSSSTAYMELARLTSEDSAIYYCAR RAGNAM------DY WGQGTSVTVSS
46A   KATMTVDKSSSTAYMELARLTSEDSAIYYCAR RAGTAM------DY WGQGTSVTVSS
97A   KATMTVDKSSSTAYMELARLTSEDSAIYYCAR RAGNAM------DY WGQGTSVTVSS
128A  KATMTVDKSSSTAYMELARLTSEDSAIYYCAR RAGNAM------DY WGQGTSVTASS
146C  KATMTVDKSSRTAYMELARLTSEDSAIYYCAR RAGNAM------DY WGQGTSVTASS
208A  KATMTVDKSSSTAYMELARLTSEDSAIYYCAR RAGNAM------DY WGQGTSVTVSS
consensus                              RAGNAM------DY

215A  KATLTVDKSSSTAYMELLSLTSEDSAVYYCAR RAYGYAM-----DY WGQGTSVTVSS

26A   KATLTVDKSSSTAYMELLSLTSEDSAVYYCAR RAYGYAM-----DY WGQGTSVTVSS

164A  KATLTVDKSSTTAYMQLKSLTSEDSAVYYCTR SNYGYYGYF---DV WGAGTTVTVSS

230A  KATLTVDKSSSTAYMQLKSLTSEDSAVYYCAR DYDYALGYF---DV WGAGTTVTVSS

76E1  KATLTVDKSSSTAYMQLKSLTSEDSAVYYCAT STMITPF-----DY WGQGTLTVSS

53A   KATLTSDKSSSTAYMELSSLTSEDSAVYYCAR FDYDTL------RY WGQGTTLTVSS
259A  KATLTSDKSSSTAYMDLSSLTSEDSAVYYCAR FDYDTL------RY WGQGTTLTVSS
consensus                              FDYDTL------RY 33A   KATFTADTSSNTAYMQLSGLTSEDSAVYYCAR WLLYYYAM----VY WGQGTSVTVSS
39A   KATFTADTSSNTAYMQLSSLTSEDSAVYYCAR WLLYYYAM----DY WGQGTSVTVSS
124A  KATFTADTSSNTAYMQLSSLTSEDSAVYYCAR WLLYYYAM----DY WGQGTSVTVSS
175A  KATFTADTSSNTAYMQLSSLTSEDSAVYYCAR WLLYYYAM----DF WGQGTSVTVSS
321D  KATFTADTSSNTAYMQLSSLTSEDSAVYYCAR WLLYYYAM----DY WGQGTSVTVSS
consensus                              WLLYYYAM----DY 141A  KATFTADTSSNTAYMQLSSLTSEDSAVYYCAG EEVDGYPWF---GY WGQGTLVIVSA
51A   KATFTADTSSNTAYMQLSSLTSEDSAVYYCAS EEVDGYPWF---GY WGQGTLVIVSA
consensus                              EEVDGYPWF---GY

353A  KFIISRDNAKNTLYLQMSKVRYEDTALYYCAR PGEIYYGSYWFAY WGQGTLVTVSA

305A  RISITRDTSKNQFFLKLNSVITEDTATYYCAR RHDYLSF-----AY WGQGTLVIVSA
```

| VL Domains | | | | | | | | |
|---|---|---|---|---|---|---|---|---|
| AbM# | | 10 | 20 24 | 30 | 34 | 40 | 50 | 56 |
| 5B | NIVMTQTPKFLLVSAGDRVTITC | KASQSVS | ---------- | NDVA | WYQQKPGQSPKLLIY | YASNRYT |
| 46A | SIVMTQTPKFLLVSAGDRVTITC | KASQSVS | ---------- | NDVA | WYQQKPGQSPKLLIY | YASNRYT |
| 97A | SIVMTQTPKFLLVSAGDRVAITC | KASQSVS | ---------- | NDVA | WYQQKPGQSPKLLIY | YASNRYT |
| 128A | NIAMTQTPKFLLVSAGDRVTITC | KASQSVS | ---------- | NDIA | WYQQKPGQSPRLLIY | YASNRYT |
| 146C | NIAMTQTPKFLLVSAGDRVTITC | KASQSVS | ---------- | NDIA | WYQQKPGQSPRLLIY | YASNRYT |
| 208A | SIVMTQTPKFLLVSAGDRVTITC | KASQSVS | ---------- | NDVA | WYQQKPGQSPKLLIY | YASNRYT |
| consensus | | | KASQSVS | | ND*A | | YASNRYT |
| 215A | QIVLTQSPAIMSASPGEKVTMTC | SASSSVS | ---------- | YMF | WYQQKPGSSPRLLIY | DTSNLAS |
| 26A | QIVLTQSPAIMSASPGEKVTMTC | SASSSVS | ---------- | YMY | WYQQKPGSSPRLLIY | DTSNLAS |
| 164A-1 | NIMMTQSPSSLAVSAGEKVTMSC | KSSQSVLYSSNQKNYLA | | | WYQQKPGQSPKLLIY | WASTRES |
| 164A-2 | ENVLTQSPAIMAASPGEKVTMTC | SASSSVSS | ---------- | SNLH | WYQQKSGTSTKFWIY | RTSNLAS |
| 230A | DVVMTQTPLSLPVSLGDQASISC | RSSQSLVHSNGN | -TYLH | WYLQKPGQSPKLLIY | KVSNRFS |
| 76E1 | DVLMTQTPLSLPVSLGDQASISC | RSSQSIVHSNGN | -TYLE | WYLQKPGQSPKLLIY | KVSNRFS |
| 53A | DVVLTQTPLSLPVNIGDQASISC | KSTKSLLNSDGF | -TYLD | WYLQKPGQSPQLLIY | LVSNRFS |
| 259A | DVVLTQTPLSLPVNIGDQASISC | KSTKSLLNSDGF | -TYLD | WYLQKPGQSPQLLIY | LISNRFS |
| consensus | | KSTKSLLNSDGF | -TYLD | | | L*SNRFS |
| 33A | DVLMTQTPLSLPVSLGDQASISC | RSSQSIVHSNGN | -TYLE | WYLQKPGQSPKLLIY | KVSNRFS |
| 39A | DVLMTQTPLSLPVSLGDPASISC | RSSQSIVHNNGN | -TYLE | WYLQKPGQSPKLLIY | KVSNRFS |
| 124A | DVLMTQTPLSLPVSLGDQASISC | RSSQSIVHNNGN | -TYLE | WYLQKPGQSPKLLIY | KVSNRFS |
| 175A | DVLMTQTPLSLPVSLGDQASISC | RSSQSIVHSNGN | -TYLE | WYLQKPGQSPKLLIY | KLSNRFS |
| 321D | DVLMTQTPLSLPVSLGDQASISC | RSSQSIVHSNGN | -TYLE | WYLQKPGQSPKLLIY | KVSNRFS |
| | | RSSQSIVH*NGN | -TYLE | | | K*SNRFS |
| 141A | QIVLSQSPAILSASPGEKVTMTC | RASSSL | ---------- | SYMH | WYQQKPGSSPKPWIY | ATSNLAS |
| 51A | QIVLSQSPAILSASPGEKVTMTC | RASSSL | ---------- | SYMH | WYQQRPGSSPKPWIY | ATSNLAS |
| consensus | | RASSSL | | SYMH | | ATSNLAS |
| 353A | DIVLTQSPASLAVSLGQRATISC | RASESVEYYGT | ---SLMQ | WFQQKPGQPPKLLIY | AASNVES |
| 305A | DIVLTQSPASLAVSLGQRATISC | KASQSVDYDGD | ---SYMN | WYQQKPGQPPKLLIY | AASNLES |

FIG. 18C

```
AbM#       60         70         80      89------97
5B     GVPDRFTGSGYGTDFTFTISTVQAEDLAVYFC QQDYSSPRT FGGGTKLEIK
46A    GVPDRFTGSGYGTDFTFTISTVQAEDLAVYFC QQDYGSPRT FGGGTKLEIK
97A    GVPDRFTGSGYGTDFTFTISTVQAEDLAVYFC QQDYGSPRT FGGGTKLEIK
128A   GVPDRFTGSGYGTDFTFTISTVQAEDLAVYFC QQDYSSPRT FGGGTKLEIK
146C   GVPDRFTGSGYGTDFTFTISTVQAEDLAVYFC QQDYSSPRT FGGGTKLEIK
208A   GVPDRFTGSGYGTDFTFTISTVQAEDLAVYFC QQDYSSPRT FGGGTKLEIK
consensus                                QQDY*SPRT
215A   GVPLRFSGSGSGTSYSLTISRMEAEDAATYYC QQWSSYPFT FGSGTKLEIK
26A    GVPLRFSGSGSGTSYSLTISRMEAEDAATYYC QQWSSYPFT FGSGTKLEIK
164A-1 GVPDRFTGSGSGTDFTLTISSVQAEDLAVYYC HQFLSS-YT FGGGTKLEMK
164A-2 EVPAPFSGSGSGTSYSLTISSVEAEDAATYYC QQWSGYPRT FGGGTKLEIK
230A   GVPDRFSGSGSGTDFTLKISRVEAEDLGVYFC SQSTHVPYT FGGGTKLEIK
76E1   GVPDRFSGSGSGTDFTLKINRVEAEDLGVYYC FQGSHVPWT FGGGTKLEIK
53A    GVPDRFSGSGSGTDFTLKISRVEAEDLGVYYC FQSNYFPWT FGGGTKLEIK
259A   GVPDRFSGSGSGTDFTLKISRVEAEDLGVYYC FQSNYFPWT FGGGTKLEIK
consensus                                FQSNYFPWT
33A    GVPDRFSGSGSGTDFTLKISRVEAEDLGVYYC FQGSHVPYT FGGGTKLEIK
39A    GVPDRFSGSGSGTDFTLKISRVEAEDLGVYYC FQGSHVPYT FGGGTKLEIK
124A   GVPDRFSGSGSGTDFTLKISRVEAEDLGVYYC FQGSHVPYT FGGGTKLEIK
175A   GVPDRFSGSGSGTDFTLKISRVEAEDLGVYYC FQGSHFPYT FGGGTKLEIK
321D   GVPDRFSGSGSGTDFTLKITRVEAEDLGVYYC FQGSHVPFT FGGGTKLEIK
consensus                                FQGSH*PFT
141A   GVPARFSGSGSGTSYSLTISRVEAEDAATYYC QQWSSNPYT FGGGTKLEIK
51A    GVPARFSGSGSGTSYSLTISRVEAEDAATYYC QQWSSNPYT FGGGTKLEIK
consensus                                QQWSSNPYT
353A   RVPARFSGSGSGTDFSLNIHPVEEDDIAMYFC QQSRKDPWT FGGGTKLEIK
305A   GIPARFSGSGSGTDFTLNIHPVEEDDAATYYC QQSDEDPYT FGGGTKLEIK
```

FIG. 18D

| mAb | Human VH Germline | Human VL Germline | Paratope Bin |
|---|---|---|---|
| 5B | IGHV1-46 | IGKV1-39 | 1 |
| 46A | IGHV1-46 | IGKV1-39 | 1 |
| 97A | IGHV1-46 | IGKV1-39 | 1 |
| 128A | IGHV1-46 | IGKV1-39 | 1 |
| 146C | IGHV1-46 | IGKV1-39 | 1 |
| 208A | IGHV1-46 | IGKV1-39 | 1 |
| 215A | IGHV1-46 | IGKV1-39 | 1 |
| 26A | IGHV1-46 | IGKV3-11 | 2 |
| 164A | IGHV1-46 | IGKV3-11 | 3 |
| 230A | IGHV1-46 | IGKV4-1 | 4 |
| 76E1 | IGHV1-46 | IGKV3D-20 | 4 |
| 53A | IGHV1-18 | IGKV2-30 | 5 |
| 259A | IGHV1-46 | IGKV2-28 | 6 |
| 33A | IGHV1-46 | IGKV2-29 | 7 |
| 39A | IGHV1-46 | IGKV2-29 | 7 |
| 124A | IGHV1-46 | IGKV2-30 | 8 |
| 175A | IGHV1-46 | IGKV2-30 | 8 |
| 321D | IGHV1-18 | IGKV2-30 | 8 |
| 141A | IGHV1-46 | IGKV2-28 | 8 |
| 51A | IGHV1-46 | IGKV2-30 | 9 |
| 353A | IGHV3-74 | IGKV3-20 | 9 |
| 305A | IGHV4-61 | IGKV3-20 | 9 |
| | | IGKV1-39 | 10 |
| | | IGKV1-39 | 11 |

FIG. 19

Human VH germline sequences

IGHV1-18*01
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYC
AR

IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYC
AR

IGHV3-74*01
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYC
AR

IGHV4-61*01
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYY
CAR

FIG. 20A

Human VL kappa germline sequences

IGKV1-39*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP

IGKV2-28*01
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPP

IGKV2-29*02
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPP

IGKV2-30*02
DVVMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPP

IGKV3-11*01
EIVLTQSPATLSLSPGERATLSCRASQSVSSYLAWYQQKPGQAPRLLIYDASNRATGIPARFSGSGSGTDFTLTISSLEPEDFAVYYCQQRSNWPP

IGKV3-20*01
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPP

IGKV3D-20*01
EIVLTQSPATLSLSPGERATLSCGASQSVSSSYLAWYQQKPGLAPRLLIYDASSRATGIPDRFSGSGSGTDFTLTISRLEPEDFAVYYCQQYGSSPP

IGKV4-1*01
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPP

FIG. 20B

```
              MGVPXXXEAXSXRWGXLLXAXFLAASXGXVAAFKVXTPYSLYVCPEGQNXTLTCRXLGPV
human         MGVPTALEAGSWRWGSLLFALFLAASLGPVAAFKVATPYSLYVCPEGQNVTLTCRLLGPV
mouse         MGVPAVPEASSPRWGTLLLAIFLAASRGLVAAFKVTTPYSLYVCPEGQNATLTCRILGPV
                        10        20        30        40        50        60

XKGHDVTXYKTWYXSSRGEVQXCXEXRPIRNXTXQQLXXHHGXHXXANXSHDXXQXHGLEXASDHHGNFS
              DKGHDVTFYKTWYRSSRGEVQTCSERRPIRNLTFQDLHLHHGGHQAANTSHDLAQRHGLESASDHHGNFS
              SKGHDVTIYKTWYLSSRGEVQMCKEHRPIRNFTLQHLQ-HHGSHLKANASHDQPQKHGLELASDHHGNFS
                        70        80        90       100       110       120

ITXRNXTXXDSGLYCCLVXEXXXHHXEXRXXGXMELQVQXGKXXXSXCXXXXSXXQDSXXITA
              ITMRNLTLLDSGLYCCLVEEIRHHHSEHRVHGAMELQVQTGKDAPSNCVVYPSSSQDSENITA
              ITLRNVTPRDSGLYCCLVIELKNHHPEQRFYGSMELQVQAGKGSGSTCMA--SNEQDSDSITA
                       140       150       160       170       180       190
```

FIG. 21A CONTINUED

```
Potential humanized sequence based on IMGT IGHV1-46*01 acceptor framework (AbM CDR definition)
IGHV1-46*01 QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
Joining region IMGT J00256|IGHJ4*01|YFDYWGQGTLVTVSS seq              10         20         30         40         50         60         70         80         90
AbM              10         20         30         40         50         60         70         80      abc  90
             b b b        b b  b     b b   b b   b i       bi         i ibb     bb         a  bb          b b b x    b b b b       b b  b        bibibb
                 *                     *                      *    *         *                            *                              *
26A          EVQLQQSGPELVKPGASMKISCKAS GYTFTSYMH  WVKQSHVKNLEWIG  IINPSGGSTS  YNQKFKGKATLTVDKSSSTAYMELLSLTSEDSAVYYCAR 1-46*01      QVQLVQSGAEVKKPGASVKVSCKAS GFSFTGYTMN WVRQAPGQGLEWMG LISPYNGGTS YAQKFQGRVTMTRDTSTSTVYMELSSLRSEDTAVYYCAR
h26AH1       QVQLVQSGAEVKKPGASVKISCKAS GFSFTGYTMN WVRQAPGQGLEWIG LISPYNGGTS YAQKFQGRVTMTRDTSTSTAYMELSSLRSEDTAVYYCAR
h26AH2       QVQLVQSGAEVKKPGASVKISCKAS GFSFTGYTMN WVRQAPGQGLEWIG LISPYNGGTS YAQKFQGRATLTVDTSTSTAYMELSSLRSEDTAVYYCAR
h26AH3       QVQLVQSGAEVKKPGASVKISCKAS GFSFTGYTMN WVRQAPGQGLEWIG LISPYNGGTS YAQKFQGRATLTVDKSTSTAYMELSSLRSEDTAVYYCAR
                 V        M                                                      #                        N seq          100        110
AbM          100        110
                    b   i bbb
26A          RAYGYAMDY WGQGTSVTVSS
h26AH1       RAYGYAMDY WGQGTLVTVSS
h26AH2       RAYGYAMDY WGQGTLVTVSS
h26AH3       RAYGYAMDY WGQGTLVTVSS (1) CDR sequences noted in bold. CDR definitions are AbM definition from website www.bioinf.org.uk/abs/.

(2) Human germline and joining sequences from IMGT® the international ImMunoGeneTics® information system
    www.imgt.org (founder and director: Marie-Paule Lefranc, Montpellier, France).

(3) Residue numbering shown as sequential (seq) or according to Chothia from website
    www.bioinf.org.uk/abs/ (AbM).

(4) "b" notes buried sidechain; "p" notes partially buried; "i" notes sidechain at interface between
    VH and VL domains.

(5) Sequence differences between human and murine germlines noted by asterisk (*).

(6) Potential changes in CDR sequences noted below each CDR sequence. These may prevent asparagine
    (N) deamidation.
```

FIG. 22A

```
Potential humanized sequence based on IMGT IGKV3-11*01 acceptor framework (AbM CDR definition)
IGHV3-11*01 EIVLTQSPATLSLSPGERATLSCRASQSVSSYLAWYQQKPGQAPRLLIYDASNRATGIPARFSGSGSGTDFTLTISSLEPEDFAVYYCQQRSNWPP
Joining region IMGT J00242|IGKJ2*01|YTFGQGTKLEIK seq              10         20         30         40         50         60         70         80
AbM              10         20         30         40         50         60         70         80
                 b   b  b       b     b      b    b   b  i  ilibbi     b               b  b  bb bib
26A     QIVLTQSPAIMSASPGEKVTMTC SASSSVS-YMY WYQKPGSSPRLLIY DTSNLAS GVPLRFSGSGSGTSYSLTISRMEAEDAATYYC
          *            *   * *   ***  * **      *     *           *   *  ** *         *  * ****

IGKV3-11 EIVLTQSPATLSLSPGERATLSC RASQSVSSYLA WYQQKPGQAPRLLIY DASNRAT GIPARFSGSGSGTDFTLTISSLEPEDFAVYYC
h26AL1   EIVLTQSPATLSLSPGERATLSC SASSSVS-YMY WYQQKPGQAPRLLIY DTSNLAS GIPARFSGSGSGTDFTLTISSLEPEDFAVYYC
h26AL2   EIVLTQSPATLSLSPGERVTMSC SASSSVS-YMY WYQQKPGQAPRLLIY DTSNLAS GIPARFSGSGSGTDYTLTISSLEPEDFAVYYC
h26AH3   EIVLTQSPATMSASPGERVTMSC SASSSVS-YMY WYQQKPGQAPRLLIY DTSNLAS GVPARFSGSGSGTDYTLTISSMEPEDFAVYYC
                                                              #                                A seq      90           100
AbM      90           100
         ibi  iib    b  b  b
26A      QQWSSYPFT    FGSGTKLEIK
              *

IGKV3-11 QQRSNWPP
h26AL1   QQWSSYPFT    FGQGTKLEIK
h26AL2   QQWSSYPFT    FGQGTKLEIK
h26AL3   QQWSSYPFT    FGQGTKLEIK (1) CDR sequences noted in bold. CDR definitions are AbM definition from website www.bioinf.org.uk/abs/.

(2) Human germline and joining sequences from IMGT® the international ImMunoGeneTics® information system
    www.imgt.org (founder and director: Marie-Paule Lefranc, Montpellier, France).

(3) Residue numbering shown as sequential (seq) or according to Chothia from website
    www.bioinf.org.uk/abs/ (AbM).

(4) "b" notes buried sidechain; "i" notes sidechain at interface between VH and VL domains.

(5) Sequence differences between human and murine germlines noted by asterisk (*).

(6) Potential additional mutations in frameworks are noted below sequence.

(7) Potential changes in CDR sequences noted below each CDR sequence.
```

FIG. 22B

```
Potential humanized sequence based on IMGT IGHV1-46*01 acceptor framework (AbM CDR definition)
IGHV1-46*01 QVQLVQSGAEVKKPGASVKVSCKASGYTFTSYYMHWVRQAPGQGLEWMGIINPSGGSTYAQKFQGRVTMTRDTSTSTVYMELSSLRSEDTAVYYCAR
Joining region  IMGT J00256|IGHJ4*01|YFDYWGQGTLVTVSS seq                10         20         30         40         50         60         70         80    abc  90
AbM                10         20         30         40         50         60         70         80         90
         b b b b  b p p b    b b b b b b    b b b        b i i       i bb b          i b      b b b b b b b b b bibibb    b
128A     QVQLQQSGAELVRPGVSVKISCKGSGYTFTDYGMHWVKQSHAKSLEWIGLIDTYYGDATYNHKFKGKATMTVDKSSRTAYMELARLTSEDSAIYYCAR
         *******   *** **   * ********   ******* *  ** ****   * ***  *** * ** **  *** **  ** **** ******
1-46*01  QVQLVQSGAEVKKPGASVKVSCKASGYTFTSYYMH WVRQAPGQGLEWMGIINPSGGSTSYAQKFQGRVTMTRDTSTSTVYMELSSLRSEDTAVYYCAR
h128AH1  QVQLVQSGAEVKKPGASVKVSCKASGYTFTDYGMH WVRQAPGQGLEWIGLIDTYYGDATYAQKFQGRVTMTRDTSTSTVYMELSSLRSEDTAVYYCAR
h128AH2  QVQLVQSGAEVKKPGASVKISCKGSGYTFTDYGMH WVRQAPGQGLEWIGLIDTYYGDATYAQKFQGRCTMTRDTSTSTVYMELSSLRSEDTAVYYCAR
h128AH3  QVQLVQSGAEVKKPGASVKISCKGSGYTFTDYGMH WVRQAPGQGLEWIGLIDTYYGDATYAQKFQGRATMTVDTSTSTAYMELSSLRSEDTAVYYCAR
                                                                        N seq       100        110
AbM       100        110
          b          b b b
128A      RAGNAMDY   WGQGTSVTASS
                     *
h128AH1   RAGNAMDY   WGQGTSVTASS
h128AH2   RAGNAMDY   WGQGTLVTVSS
h128AH3   RAGNAMDY   WGQGTLVTVSS
                    A (1) CDR sequences noted in bold. CDR definitions are AbM definition from website www.bioinf.org.uk/abs/.

(2) Human germline and joining sequences from IMGT® the international ImMunoGeneTics® information system
    www.imgt.org (founder and director: Marie-Paule Lefranc, Montpellier, France).

(3) Residue numbering shown as sequential (seq) or according to Chothia from website
    www.bioinf.org.uk/abs/ (AbM).

(4) "b" notes buried sidechain; "p" notes partially buried; "i" notes sidechain at interface between
    VH and VL domains.

(5) Sequence differences between human and murine germlines noted by asterisk (*).

(6) Potential additional mutations in frameworks are noted below sequence.
```

FIG. 23A

```
Potential humanized sequence based on IMGT IGKV1-39*01 acceptor framework (AbM CDR definition)
IGKV1-39*01 DIQMTQSPSSLSASVGDRVTITCRASQSISSYLNWYQQKPGKAPKLLIYAASSLQSGVPSRFSGSGSGTDFTLTISSLQPEDFATYYCQQSYSTPP
Joining region IMGT J00242|IGKJ2*01|YTFGQGTKLEIK seq              10        20         30         40         50         60         70        80
AbM              b b       b  b b     b bi bi    bi ibbi     ibbi   b          b            bb bib
128A    NIAMTQTPKFLLVSAGDRVTITC KASQSVSNDIA WYQQKPGQSPRLLIY YASNRYT GVPDRFTGSGYGTDFFTISTVQAEDLAVYFC
         *   ** **    **  *      *         *    *       # *        *    * *  *            *   L F
IGKV1-39   b b       b  b b     b bi bi    bi ibbi     ibbi   b          b            bb b b    bb bib
h128AL1  DIQMTQSPSSLSASVGDRVTITC RASQSISSYLN WYQQKPGKAPKLLIY AASSLQS GVPSRFSGSGSGTDFTLTISSLQPEDFATYYC
h128AL1  DIQMTQSPSSLSASVGDRVTITC KASQSVSNDIA WYQQKPGKAPKLLIY YASNRYT GVPSRFSGSGSGTDFTLTISSLQPEDFATYYC
h128AL2  DIQMTQSPSSLSVSVGDRVTITC KASQSVSNDIA WYQQKPGKAPKLLIY YASNRYT GVPSRFSGSGSGTDFTFTISSVQPEDFATYYC
h128AL3  DIQMTQSPSSLSVSVGDRVTITC KASQSVSNDIA WYQQKPGKAPKLLIY YASNRYT GVPSRFSGSGYGTDFTFTISSVQPEDFATYYC
                                            S                # seq       90       100
AbM       ibi iib i   b b b
128A    QQDYSSPRT FGQGTKLEIK
                      *
IGKV1-39  QQSYSTPP
h128AL1  QQDYSSPRT FGQGTKLEIK
h128AL2  QQDYSSPRT FGQGTKLEIK
h128AL3  QQDYSSPRT FGQGTKLEIK (1) CDR sequences noted in bold. CDR definitions are AbM definition from website www.bioinf.org.uk/abs/.

(2) Human germline and joining sequences from IMGT® the international ImMunoGeneTics® information system
    www.imgt.org (founder and director: Marie-Paule Lefranc, Montpellier, France).

(3) Residue numbering shown as sequential (seq) or according to Chothia from website
    www.bioinf.org.uk/abs/ (AbM).

(4) "b" notes buried sidechain; "i" notes sidechain at interface between VH and VL domains.

(5) Sequence differences between human and murine germlines noted by asterisk (*).

(6) Potential additional mutations in frameworks are noted below sequence.

(7) Potential changes in CDR sequences noted below each CDR sequence. These may prevent asparagine (N)
    deamidation.
```

FIG. 23B

```
Potential humanized sequence based on IMGT IGHV1-46*01 acceptor framework (AbM CDR definition)
IGHV1-46*01 QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
Joining region IMGT J00256|IGHJ4*01|YFDYWGQGTLVTVSS seq                 b b  b           p b  b b           b b      b    i bb b               b b b b  i bb b b    x           b b b b b b b b          bibibb
AbM         10         20           30         40          50         60         70         80   abc  90
124A        10         20           30         40          50         60         70         80         90
124A        QVQLQQSGAELMKPGASVKISCKAT GYTFSSNWIE WLKQRPGHGLEWMG EILPGSGSTS YNEKFKGKATFTADTSSNTAYMQLSSLTSEDSAVYYCAR
                *                       *        *      #                    i                *
1-46*01     QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h124AH1     QVQLVQSGAEVKKPGASVKVSCKAS GYTFSSNWIE WVRQAPGQGLEWMG EILPGSGSTS YAQKFQGRVTMTRDTSTSTVYMELSSLRSEDTAVYYCAR
h124AH2     QVQLVQSGAEVKKPGASVKISCKAS GYTFSSNWIE WVRQAPGQGLEWMG EILPGSGSTS YAQKFQGRATFTADTSTSTAYMELSSLRSEDTAVYYCAR
                                                                                       N seq           b b     i bb b
AbM       100       110
124A      100       110
124A      WLLYYYAMDF WGQGTSVTVSS
                     *
h124AH1   WLLYYYAMDF WGQGTLVTVSS
h124AH2   WLLYYYAMDF WGQGTLVTVSS
```

(1) CDR sequences noted in bold. CDR definitions are AbM definition from website www.bioinf.org.uk/abs/.

(2) Human germline and joining sequences from IMGT® the international ImMunoGeneTics® information system www.imgt.org (founder and director: Marie-Paule Lefranc, Montpellier, France).

(3) Residue numbering shown as sequential (seq) or according to Chothia from website www.bioinf.org.uk/abs/ (AbM).

(4) "b" notes buried sidechain; "p" notes partially buried; "i" notes sidechain at interface between VH and VL domains.

(5) Sequence differences between human and murine germlines noted by asterisk (*).

(6) Potential changes in CDR sequences noted below each CDR sequence. These may prevent asparagine (N) deamidation.

FIG. 24A

```
Potential humanized sequence based on IMGT IGKV2-30*01 acceptor framework (AbM CDR definition)
IGKV2-30*01 DVVMTQTPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPP
Joining region IMGT J00242|IGKJ2*01|YTFGQGTKLEIK seq             10         20          30                40         50          60         70        80         90
AbM           b  b  b  b  b   b  b  b  b  bbcde bi  bi  i  i  ibbi  i           b  b              b  b  b   b  bb bib
124A          DVLMTQTPLSLPVSLGDQASISC RSSQSIVHNNGNTYLE WYLQKPGQSPKLLIY KVSNRFS  GVPDRFSGSGSGTDFTLKISRVEAEDLGVYYC
                *                     *  *             *  *                                                *

IGKV2-30      DVVMTQSPLSLPVTLGQPASISC RSSQSLVYSDGNTYLN WFQQRPGQSPRRLIY KVSNRDS  GVPDRFSGSGSGTDFTLKISRVEAEDVGVYYC
h124AL1       DVVMTQSPLSLPVTLGQPASISC RSSQSIVHNNGNTYLE WFQQRPGQSPRRLIY KVSNRFS  GVPDRFSGSGSGTDFTLKISRVEAEDVGVYYC
h124AL2       DVVMTQSPLSLPVTLGQPASISC RSSQSIVHNNGNTYLE WYQQRPGQSPRLLIY KVSNRFS  GVPDRFSGSGSGTDFTLKISRVEAEDLGVYYC
                                      # @  #                                    #                          * seq           90     100    110
AbM           ibi  iib  i   b  b  b
124A          FQGSHVPYT FGGGTKLEIK
                       *

IGKV2-30      MQGTHWPP
h124AL1       FQGSHVPYT FGQGTKLEIK
h124AL2       FQGSHVPYT FGQGTKLEIK
```

(1) CDR sequences noted in bold. CDR definitions are AbM definition from website www.bioinf.org.uk/abs/.

(2) Human germline and joining sequences from IMGT® the international ImMunoGeneTics® information system www.imgt.org (founder and director: Marie-Paule Lefranc, Montpellier, France).

(3) Residue numbering shown as sequential (seq) or according to Chothia from website www.bioinf.org.uk/abs/(AbM).

(4) "b" notes buried sidechain; "i" notes sidechain at interface between VH and VL domains.

(5) Sequence differences between human and murine germlines noted by asterisk (*).

(6) Potential additional mutations in frameworks are noted below sequence.

(7) Potential changes in CDR sequences noted below each CDR sequence. These may prevent asparagine (N) deamidation or isoaspartate formation (DG).

FIG. 24B

```
Potential humanized sequence based on IMGT IGHV1-46*01 acceptor framework (AbM CDR definition)
IGHV1-46*01_QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
Joining region IMGT J00256|IGHJ4*01|YFDYWGQGTLVTVSS 10         20         30         40         50         60         70        80   abc    90
seq                   10         20         30         40         50       a 60         70        80 b b b      90
AbM       b b b              b b b   b       b        b i i      i b b b     i          b b b x       b b b       b i b i b b
259A      EVQLQQSGPELVKPGASVKMSCKASGYTFTSYFMH WVKQKPGQGLEWIG YIYPYNDGTK YNEKFKGKATLTSDKSSSTAYMDLSSLTSEDSAVYYCAR
          *  **                *       *  *              *                                   *            *            * *
1-46*01   QVQLVQSGAEVKKPGASVKVSCKASGYTFTSYYMH WVRQAPGQGLEWMG IINPSGGSTS YAQKFQGRVTMTRDTSTSTVYMELSSLRSEDTAVYYCAR
h259AH1   QVQLVQSGAEVKKPGASVKVSCKASGYTFTSYFMH WVRQAPGQGLEWMG YIYPYNDGTK YAQKFQGRVTMTRDTSTSTVYMELSSLRSEDTAVYYCAR
h259AH2   QVQLVQSGAEVKKPGASVKMSCKASGYTFTSYFMH WVRQAPGQGLEWIG YIYPYNDGTK YAQKFQGRATLTSDTSTSTAYMELSSLRSEDTAVYYCAR
h259AH3   QVQLVQSGAEVKKPGASVKMSCKASGYTFTSYFMH WVRQAPGQGLEWIG YIYPYNDGTK YAQKFQGRATLTSDKSTSTAYMELSSLRSEDTAVYYCAR
                    V                                          #@           N 100          110
seq         100          110
AbM       b            b b b
259A      FDYDTLRY    WGQGTLVTVSS
                      *  *
h259AH1   FDYDTLRY    WGQGTLVTVSS
h259AH2   FDYDTLRY    WGQGTLLTVSS
h259AH3   FDYDTLRY    WGQGTLLTVSS (1)  CDR sequences noted in bold. CDR definitions are AbM definition from website www.bioinf.org.uk/abs/.

(2)  Human germline and joining sequences from IMGT® the international ImMunoGeneTics® information system
     www.imgt.org (founder and director: Marie-Paule Lefranc, Montpellier, France).

(3)  Residue numbering shown as sequential (seq) or according to Chothia from website
     www.bioinf.org.uk/abs/ (AbM).

(4)  "b" notes buried sidechain; "p" notes partially buried; "i" notes sidechain at interface between
     VH and VL domains.

(5)  Sequence differences between human and murine germlines noted by asterisk (*).

(6)  Potential additional mutations in frameworks are noted below sequence.

(7)  Potential changes in CDR sequences noted below each CDR sequence. These may prevent asparagine (N)
     deamidation or isoaspartate formation (DG).
```

FIG. 25A

```
Potential humanized sequence based on IMGT IGKV2-28*01 acceptor framework (AbM CDR definition)
IGKV2-28*01 DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPP
Joining region IMGT J00242|IGKJ2*01|YTFGQGTKLEIK 10          20          30            40          50          60          70          80          90
seq           b           b           b             bi  bi      i  ibbi     b           b  b        bb  bb  bib
AbM           b b         b b b       b  30abcde    b                      i           b           b  b      *

259A          DVVLTQTPLSLPVNIGDQASISC KSTKSLLNSDGFTYLD WYLQKPGQSPQLLIY LISNRFS GVPDRFSGSGSGTDFTLKISRVEAEDLGVYYC
                *           *   *             #@                    #

IGKV2-28      DIVMTQSPLSLPVTPGEPASISC RSSQSLLHSNGYNYLD WYLQKPGQSPQLLIY LGSNRAS GVPDRFSGSGSGTDFTLKISRVEAEDVGVYYC
h259AL1       DIVMTQSPLSLPVTPGEPASISC KSTKSLLNSDGFTYLD WYLQKPGQSPQLLIY LISNRFS GVPDRFSGSGSGTDFTLKISRVEAEDVGVYYC
h259AH2       DIVLTQSPLSLPVTPGEPASISC KSTKSLLNSDGFTYLD WYLQKPGQSPQLLIY LISNRFS GVPDRFSGSGSGTDFTLKISRVEAEDLGVYYC
                V                              #                                                            *

90          100         110
seq           ibi   iib   i   b b b
AbM                                   *
259A          FQSNYFPWT   MQALQTPP
                          FGQGTKLEIK
IGKV2-28
h259AL1       FQSNYFPWT   FGGGTKLEIK
h259AH2       FQSNYFPWT   FGGGTKLEIK
```

(1) CDR sequences noted in bold. CDR definitions are AbM definition from website www.bioinf.org.uk/abs/.

(2) Human germline and joining sequences from IMGT® the international ImMunoGeneTics® information system www.imgt.org (founder and director: Marie-Paule Lefranc, Montpellier, France).

(3) Residue numbering shown as sequential (seq) or according to Chothia from website www.bioinf.org.uk/abs/ (AbM).

(4) "b" notes buried sidechain; "i" notes sidechain at interface between VH and VL domains.

(5) Sequence differences between human and murine germlines noted by asterisk (*).

(6) Potential additional mutations in frameworks are noted below sequence.

(7) Potential changes in CDR sequences noted below each CDR sequence. These may prevent asparagine (N) deamidation or isoaspartate formation (DG).

FIG. 25B

ANTI-C10ORF54 ANTIBODIES AND USES THEREOF

CROSS REFERENCE TO RELATED APPLICATIONS

This application is a national phase application based on PCT/US2015/065331, filed Dec. 11, 2015, which claims the benefit of U.S. Provisional Application No. 62/090,880, filed Dec. 11, 2014, the contents of all of which are incorporated herein by reference.

REFERENCE TO SEQUENCE LISTING SUBMITTED ELECTRONICALLY

An official copy of the sequence listing is submitted electronically via EFS-Web as an ASCII formatted sequence listing with a file named 03715 0215-00000 SL.txt, created on Jan. 31, 2018, and having a size of 925,488 bytes. The sequence listing contained in this ASCII formatted document is part of the specification and is herein incorporated by reference in its entirety.

FIELD

The present disclosure relates generally to anti-C10orf54 antibodies, including antibody-drug conjugates comprising the antibodies, and methods of their use.

BACKGROUND

C10orf54 is a single-pass type I transmembrane protein that is 311 amino acids in length and includes a signal sequence and one IgV-like domain in its intracellular region. It is potentially a member of the B7 family of proteins and it has approximately 24% sequence identity to B7-H1/PD-L1 (Flajnik et al., *Immunogenetic* 64:571-590 (2012)). The mouse ortholog to C10orf54 is known as V-region Immunoglobulin-containing Suppressor of T Cell Activation (VISTA; also known as PD-L3). VISTA was cloned from a library of CD4 positive regulatory T cells ($T_{reg}$) (Wang et al., *JEM* 208(3):577-592 (2011)). VISTA is primarily expressed on hematopoietic cells, and VISTA expression is highly regulated on myeloid antigen-presenting cells (APCs) and T cells (Wang et al., supra).

VISTA appears to have functional activities that are nonredundant with other Ig superfamily members and may play a role in the development of autoimmunity and immune surveillance in cancer. For example, expression of a VISTA-Ig fusion protein has been shown to inhibit T cell proliferation and cytokine production in vitro and overexpression of VISTA on MCA105 tumor cells interferes with a host's protective antitumor immunity (Wang et al., supra). Moreover, administration of a VISTA-specific monoclonal antibody enhanced CD4 positive T cell response in vivo and the development of autoimmunity (Wang et al., supra). Monoclonal antibodies against C10orf54 have also been shown to prevent acute graft-versus-host disease in mice (Flies et al., *J. Immunology* 187(4):1537-1541 (2011)). Citation or discussion of a reference herein shall not be construed as an admission that such is prior art to the present disclosure.

SUMMARY

The present disclosure provides antibodies that bind C10orf54, including humanized antibodies and antibody-drug conjugates comprising the humanized antibodies, and methods of use of the antibodies and the antibody-drug conjugates, including for the diagnosis and treatment of cancers. The present disclosure further provides proteins that bind to C10orf54, including binding proteins, such as antibodies, that bind to one or more C10orf54 proteins or chimeric proteins. Such binding proteins, including antibodies, may be antagonists (e.g., inhibit one or more of the biological activities of C10orf54).

In a first aspect, provided herein are antibodies that bind to C10orf54, including a C10orf54 polypeptide, a C10orf54 polypeptide fragment or a C10orf54 epitope, collectively referred to herein as anti-C10orf54 antibodies. Also provided herein are anti-C10orf54 antibodies that are conjugated to drugs as antibody-drug conjugates (ADCs), including ADCs of the formula A-L-CTX, wherein A is an antibody, L is a linker, and CTX is cytotoxin. In some embodiments the anti-C10orf54 antibodies are humanized antibodies that bind to a C10orf54 polypeptide, a C10orf54 polypeptide fragment or a C10orf54 epitope. In certain embodiments, the anti-C10orf54 antibody comprises a VH domain, VL domain, VH CDR1, VH CDR2, VH CDR3, VL CDR1, VL CDR2, and/or VL CDR3 of monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33), or a humanized variant thereof. In certain embodiments, the anti-C10orf54 antibody can further comprise a VH FR1, VH FR2, VH FR3, VH FR4, VL FR1, VL FR2, VL FR3, and/or VL FR4 of a human germ line immunoglobulin amino acid sequence or a variant thereof.

In certain embodiments, the antibody comprises less than six CDRs. In some embodiments, the antibody comprises or consists of one, two, three, four, or five CDRs selected from the group consisting of VH CDR1, VH CDR2, VH CDR3, VL CDR1, VL CDR2, and/or VL CDR3. In specific embodiments, the antibody comprises or consists of one, two, three, four, or five CDRs selected from the group consisting of VH CDR1, VH CDR2, VH CDR3, VL CDR1, VL CDR2, and/or VL CDR3 of the monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33), or a humanized variant thereof. In specific embodiments, the antibody further comprises a VH FR1, VH FR2, VH FR3, VH FR4, VL FR1, VL FR2, VL FR3, and/or VL FR4 of a human germline immunoglobulin amino acid sequence or a variant thereof.

In specific embodiments, the antibody is a humanized antibody, a monoclonal antibody, a recombinant antibody, an antigen binding fragment or any combination thereof. In particular embodiments, the antibody is a humanized monoclonal antibody as described herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3), or antigen binding fragment thereof, that binds to a C10orf54 polypeptide (e.g., a cell surface-expressed or soluble C10orf54), a C10orf54 fragment, or a C10orf54 epitope.

In a second aspect, provided herein are antibodies, including humanized antibodies, (i) that competitively block (e.g., in a dose-dependent manner) an anti-C10orf54 antibody provided herein from binding to a C10orf54 polypeptide (e.g., a cell surface-expressed or soluble C10orf54), a C10orf54 fragment, or a C10orf54 epitope and/or (ii) that bind to a C10orf54 epitope that is bound by an anti-C10orf54 antibody (e.g., humanized anti-C10orf54 antibodies) provided herein. In other embodiments, the antibody competitively blocks (e.g., in a dose-dependent manner) monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) or a humanized variant thereof from binding to a C10orf54 polypeptide (e.g., a cell surface-expressed or soluble C10orf54), a C10orf54 fragment, or a C10orf54 epitope. In other embodiments, the antibody binds to a C10orf54 epitope that is bound (e.g., recognized) by monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) or a humanized variant thereof (e.g. humanized anti-C10orf54 antibodies).

In certain embodiments, the anti-C10orf54 antibodies (e.g., humanized anti-C10orf54 antibodies) provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) are conjugated or recombinantly fused to a diagnostic agent, detectable agent or therapeutic agent. In some aspects, the therapeutic agent is a chemotherapeutic agent (e.g., a cystotoxic agent such as cytotoxin). In some aspects, the detectable agent is a radioisotope, an enzyme, a fluorescent compound, a bioluminescent compound or a chemiluminescent compound. In certain embodiments, the anti-C10orf54 antibodies provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) are conjugated to drugs as antibody-drug conjugates (ADCs). In some aspects, the antibody-drug conjugate (ADC) is of the formula A-L-CTX, wherein A is an antibody, L is a linker, and CTX is a cytotoxin.

In certain embodiments, provided are compositions comprising an anti-C10orf54 antibody (e.g., humanized anti-C10orf54 antibodies) described herein. In some embodiments, the compositions comprise an antibody-drug conjugate wherein the antibody is an anti-C10orf54 antibody provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3). Also provided herein are pharmaceutical compositions comprising an anti-C10orf54 antibody, including a humanized anti-C10orf54 antibody, provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3).

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC10 (SEQ ID NO: 1251), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), and CC9 (SEQ ID NO: 1250).

In certain embodiments, the antibody provided herein binds a first group of C10orf54 proteins or chimeric proteins designated CC1 (SEQ ID NO: 1079), CC4 (SEQ ID NO: 1245), CC5 (SEQ ID NO: 1246), and CC8 (SEQ ID NO: 1249), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspected, such an antibody does not comprise one or more CDR sequences selected from the group consisting of 30, 1099, 1104, 1105, 1110, 31, 1100, 1106, 1111, 1116, 32, 1101, 1107, 1112, 45, 1102, 1108, 1113, 40, 1103, 1114, 41, 1109, and 1115.

In certain embodiments, the antibody provided herein binds to a first group of C10orf54 proteins or chimeric proteins designated CC1 (SEQ ID NO: 1079), CC4 (SEQ ID NO: 1245), and CC5 (SEQ ID NO: 1246), and does not bind to a second grouped of C10orf54 proteins or chimeric proteins designated (SEQ ID NO: 1243), CC3 (SEQ ID NO: 1244), CC6 (SEQ ID NO: 1247), CC7 (SEQ ID NO: 1248), CC8 (SEQ ID NO: 1249), CC9 (SEQ ID NO: 1250), and CC10 (SEQ ID NO: 1251). In some aspects, such an antibody does not comprise one or more CDR sequences selected from the group consisting of 36, 1081, 1086, 1087, 1092, 37, 1082, 1088, 1093, 1098, 38, 1083, 1089, 1094, 45, 1084, 1090, 1095, 46, 1085, 1096, 47, 1091, and 1097.

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC9 (SEQ ID NO: 1250), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspects, such an antibody does not comprise one or more CDR sequences selected from the group consisting of 33, 1117, 1122, 1123, 1128, 34, 1118, 1124, 1129, 1134, 35, 1119, 1125, 1130, 42, 1120, 1126, 1131, 43, 1121, 1132, 44, 1127, and 1133.

In certain embodiments, the antibody provided herein binds to a first group of C10orf54 proteins or chimeric proteins designated CC1 (SEQ ID NO: 1079), CC3 (SEQ ID NO: 1244), CC4 (SEQ ID NO: 1245), CC5 (SEQ ID NO: 1246), CC8 (SEQ ID NO: 1249), and CC9 (SEQ ID NO: 1250), and does not bind to a second grouped of C10orf54 proteins or chimeric proteins designated CC2 (SEQ ID NO: 1243), CC6 (SEQ ID NO: 1247), CC7 (SEQ ID NO: 1248), and CC10 (SEQ ID NO: 1251).

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC10 (SEQ ID NO: 1251), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251).

In a third aspect, provided are isolated nucleic acid molecules encoding a VH chain, VL chain, VH domain, VL domain, VH CDR1, VH CDR2, VH CDR3, VL CDR1, VL CDR2, and/or VL CDR3 of anti-C10orf54 antibodies as described herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3), including humanized anti-C10orf54 antibodies, that bind to a C10orf54 polypeptide, a C10orf54 polypeptide fragment, or a C10orf54 epitope. In certain embodiments, the nucleic acid molecule encodes a VH domain, VL domain, VH CDR1, VH CDR2, VH CDR3, VL CDR1, VL CDR2, and/or VL CDR3 of monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33), or a humanized variant thereof. In certain embodiments, the nucleic acid molecule further encodes a VH FR1, VH FR2, VH FR3, VH FR4, VL FR1, VL FR2, VL FR3, and/or VL FR4 of a human germline immunoglobulin amino acid sequence or a variant thereof. Also provided herein are vectors and host cells comprising the nucleic acid molecules encoding an anti-C10orf54 antibody (e.g., humanized anti-C10orf54 antibodies), as well as methods of producing an anti-C10orf54 antibody by culturing the host cells provided herein under conditions that promote the production of the anti-C10orf54 antibody.

In a fourth aspect, provided herein are methods of treating, preventing or alleviating a disease, disorder or condition, including one or more symptoms of a disease, disorder or condition, comprising administering a therapeutically effective amount of an anti-C10orf54 antibody as described herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3), including an antibody-drug conjugate (ADC) comprising an anti-C10orf54 antibody, provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) to a subject, thereby treating, preventing or alleviating the disease, disorder or condition, including one or more symptoms of the disease, disorder or condition. In some embodiments the anti-C10orf54 antibodies are humanized antibodies that bind to a C10orf54 polypeptide, a C10orf54 polypeptide fragment or a C10orf54 epitope. In one embodiment, the disease, disorder or condition is caused by or otherwise associated with C10orf54, including by or associated with C10orf54-expressing cells (e.g., tumor cells, myeloid-derived suppressor cells (MDSC), suppressive dendritic cells (suppressive DC), and/or regulatory T cells (T regs)). In certain embodiments, the disease is a cancer, such as a leukemia, a bladder cancer, a skin cancer, a colon cancer, a breast cancer, a liver cancer, a kidney cancer, a lung cancer, a stomach cancer, a pancreas cancer, an esophagus cancer or a fibrosarcoma. In one embodiment, the leukemia is an acute myeloid leukemia (AML). In other embodiments, the disease is graft-versus-host disease (GVHD). Additional methods provided include using an anti-C10orf54 antibody with C10orf54 binding activity for C10orf54-expressing cells, provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3), for example, as an unconjugated antibody or conjugated antibody (ADC), including to inhibit and/or kill the C10orf54-expressing cells (e.g., with anti-tumor activity to mediate an anti-tumor effect). In certain embodiments, the anti-C10orf54 antibodies, including ADCs comprising the anti-C10orf54 antibodies, provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) inhibit C10orf54-mediated suppressor activity on T cells (e.g., to allow an effective anti-tumor immune response). In certain embodiments, the anti-C10orf54 antibodies provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) directly kill C10orf54-expressing cells (e.g., C10orf54-bearing tumor cells, myeloid-derived suppressor cells (MDSC), suppressive dendritic cells (suppressive DC), and/or regulatory T cells (T regs)), for example, via antibody-dependent cellular cytotoxicity (ADCC) and/or complement-dependent cytotoxicity (CDC) In certain embodiments, antibody drug conjugates (ADCs) comprising anti-C10orf54 antibodies provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) directly kill C10orf54-expressing cells including by binding to cells expressing C10orf54 (e.g., tumor cells, myeloid-derived suppressor cells (MDSC), suppressive dendritic cells (suppressive DC), and/or regulatory T cells (T regs)), for example, by allowing internalization of the cytotoxic drug. In certain embodiments, the anti-C10orf54 antibodies provided herein or antibody drug conjugates (ADCs) comprising anti-C10orf54 antibodies provided herein are used in methods for treating cancers (e.g., bladder, breast, colon, connective tissue, rectal, gastric, esophageal, lung, laryx, kidney, oral, ovarian, or prostate cancer, or a sarcoma, melanoma, glioma, lymphoma or leukemia) or tumors associated with myeloid-derived suppressor cells (MDSC) (e.g., colon carcinoma, mammary carcinoma, fibrosarcoma, thymoma, lung carcinoma, renal cell carcinoma, mesothelioma, glioma, lymphoma, sarcoma, prostate carcinoma, sarcoma, or head and neck carcinoma). In any of the above embodiments, the anti-C10orf54 antibody can be a humanized anti-C10orf54 antibody provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) that binds to a C10orf54 polypeptide, a C10orf54 polypeptide fragment or a C10orf54 epitope.

In a fifth aspect, provided herein are methods of inhibiting the growth of cells and/or killing cells having cell surface expression of C10orf54 comprising contacting the cells with an effective amount of an anti-C10orf54 antibody or antibody-drug conjugates comprising the anti-C10orf54 antibody provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3). In one embodiment, the cell is a regulatory T cell (e.g., a CD4$^+$ Foxp3$^+$ regulatory T cell). In certain embodiments, provided herein is a method of inhibiting the growth of a tumor with inflammation in a subject comprising administering an effective amount of the anti- C10orf54 antibodies, including ADCs comprising the anti-C10orf54 antibodies, provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3). In other embodiments, the cell is a myeloid-derived suppressor cell (e.g., a CD11b$^+$ or CD11b$^{high}$ myeloid-derived suppressor cell) or a suppressive dendritic cell (e.g., a CD11b$^+$ or CD11b$^{high}$ dendritic cell). In other embodiments, the cell is a cancerous or pre-cancerous cell. Additional methods provided include using an anti-C10orf54 antibody with C10orf54 binding activity for C10orf54-expressing cells provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3), for example, as an unconjugated antibody or conjugated antibody (ADC) including to inhibit and/or kill C10orf54-expressing cells (e.g., with anti-tumor activity to mediate an anti-tumor effect). In certain embodiments, the anti-C10orf54 antibodies, including ADCs comprising the anti-C10orf54 antibodies, provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) inhibit C10orf54-mediated suppressor activity on T cells (e.g., to allow an effective anti-tumor immune response). In certain embodiments, the anti-C10orf54 antibodies provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) directly kill C10orf54-expressing cells (e.g., C10orf54-bearing tumor cells, myeloid-derived suppressor cells (MDSC), suppressive dendritic cells (suppressive DC), and/or regulatory T cells (T regs)), for example, via antibody-dependent cellular cytotoxicity (ADCC) and/or complement-dependent cytotoxicity (CDC) In certain embodiments, antibody drug conjugates (ADCs) comprising anti-C10orf54 antibodies provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) directly kill C10orf54-expressing cells including by binding to cells expressing C10orf54 (e.g., tumor cells, myeloid-derived suppressor cells (MDSC), suppressive dendritic cells (suppressive DC), and/or regulatory T cells (T regs)), for example, by allowing internalization of the cytotoxic drug. In any of the above embodiments, the anti-C10orf54 antibody can be a humanized anti-C10orf54 antibody provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) that binds to a C10orf54 polypeptide, a C10orf54 polypeptide fragment or a C10orf54 epitope.

In a sixth aspect, provided herein are methods of modulating an immune response in a subject comprising administering an effective amount of an anti-C10orf54 antibody (e.g., a humanized anti-C10orf54 antibody) provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) to a subject. In one embodiment, the modulating comprises increasing T cell activation. In other embodiment, the modulating comprises increasing T cell proliferation. In another embodiment, the modulating comprises increasing cytokine production.

In a seventh aspect, provided herein are methods for detecting C10orf54 in a sample comprising contacting the sample with an anti-C10orf54 antibody (e.g., a humanized anti-C10orf54 antibody) provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3), such as an antibody that comprises a detectible agent. In certain embodiments, the sample comprises a cell expressing C10orf54 on its surface.

In an eighth aspect, provided herein are methods of treating cancers comprising administering to a subject an anti-C10orf54 antibody (e.g., a humanized anti-C10orf54 antibody) or an antibody-drug conjugate (ADC) comprising the anti-C10orf54 antibody (e.g., an ADC of the formula A-L-CTX, wherein A is the antibody, L is a linker, and CTX is a cytotoxic agent) provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) in a therapeutically effective amount, including in an amount effective to kill a C10orf54-expressing cell (e.g., tumor cell, myeloid-derived suppressor cell (MDSC), suppressive dendritic cell (suppressive DC), and/or regulatory T cell (T reg)). In some embodiments the cancer is acute myeloid leukemia (AML). In any of the above embodiments, the anti-C10orf54 antibody can be a humanized anti-C10orf54 antibody provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) that binds to a C10orf54 polypeptide, a C10orf54 polypeptide fragment or a C10orf54 epitope.

In a ninth aspect, provided herein are methods of killing C10orf54-expressing cells (e.g., tumor cells, myeloid-derived suppressor cells (MDSC), suppressive dendritic cells (suppressive DC), and/or regulatory T cells (T reg)) comprising contacting a C10orf54-expressing cell (e.g., tumor cell, myeloid-derived suppressor cell (MDSC), suppressive dendritic cell (suppressive DC), and/or regulatory T cell (T regs)) with an amount of an anti-C10orf54 antibody or an antibody-drug conjugate (ADC) comprising an anti-C10orf54 antibody (e.g., an ADC of the formula A-L-CTX, wherein A is the antibody, L is a linker, and CTX is a cytotoxic agent) provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) effective to kill the cell (e.g., tumor cell, myeloid-derived suppressor cell (MDSC), suppressive dendritic cell (suppressive DC), and/or regulatory T cell (T reg)). In some embodiments, the tumor cell is an AML cell. In any of the above embodiments, the anti-C10orf54 antibody can be a humanized anti-C10orf54 antibody provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3) that binds to a C10orf54 polypeptide, a C10orf54 polypeptide fragment or a C10orf54 epitope.

In a tenth aspect, provided herein is a kit comprising an anti-C10orf54 antibody (e.g., a humanized anti-C10orf54 antibody) that binds to a C10orf54 polypeptide, a C10orf54 polypeptide fragment, or a C10orf54 epitope provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3). In some embodiments, the kits comprise an antibody-drug conjugate (ADC) wherein the antibody is an anti-C10orf54 antibody (e.g., a humanized anti-C10orf54 antibody) provided herein (e.g., 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein (e.g., Tables 12-33) with a VH domain, VL domain, VH CDR1, VH CDR2, VH CDR3, VL CDR1, VL CDR2, and/or VL CDR3).

TERMINOLOGY

Unless defined otherwise, all technical and scientific terms used herein have the same meaning as is commonly understood by one of ordinary skill in the art. All patents, applications, published applications and other publications are incorporated by reference in their entirety. In the event that there are a plurality of definitions for a term herein, those in this section prevail unless stated otherwise.

The term "about" or "approximately" means within 20%, such as within 10%, or within 5% (or 1% or less) of a given value or range.

As used herein, "administer" or "administration" refers to the act of injecting or otherwise physically delivering a substance as it exists outside the body (e.g., an anti-C10orf54 antibody provided herein) into a patient, such as by mucosal, intradermal, intravenous, intramuscular delivery and/or any other method of physical delivery described herein or known in the art. When a disease, or a symptom thereof, is being treated, administration of the substance typically occurs after the onset of the disease or symptoms thereof. When a disease, or symptoms thereof, are being prevented, administration of the substance typically occurs before the onset of the disease or symptoms thereof.

As used herein, an "agonist" of C10orf54 refers to a molecule that is capable of activating or otherwise increasing one or more of the biological activities of C10orf54, such as in a cell expressing C10orf54 or in a cell expressing a C10orf54 ligand, such as a C10orf54 receptor. In some embodiments, an agonist of C10orf54 (e.g., an agonistic antibody provided herein) may, for example, act by activating or otherwise increasing the activation and/or cell signaling pathways of the cell expressing a C10orf54 or a C10orf54 receptor, thereby increasing a C10orf54-mediated biological activity of the cell the relative to the C10orf54-mediated biological activity in the absence of agonist. In certain embodiments the antibodies provided herein are agonistic anti-C10orf54 antibodies.

The term "alkyl," as used herein, means a straight, branched chain, or cyclic (in this case, it would also be known as "cycloalkyl") hydrocarbon containing from 1-10 carbon atoms. Examples of alkyl include, but are not limited to, methyl, ethyl, n-propyl, iso-propyl, n-butyl, sec-butyl, tert-butyl, n-pentyl, isopentyl, neopentyl, n-hexyl, 3-methylhexyl, 2,2-dimethylpentyl, 2,3-dimethylhexyl, n-heptyl, n-octyl, n-nonyl, and n-decyl. In certain embodiments, alkyl groups are optionally substituted.

The term "$C_{1-6}$alkyl," as used herein, means a straight, branched chain, or cyclic (in this case, it would also be known as "cycloalkyl") hydrocarbon containing from 1-6 carbon atoms.

The term "$C_{1-3}$alkyl," as used herein, means a straight or branched chain hydrocarbon containing from 1-3 carbon atoms.

The term "alkenyl," as used herein, means a straight, branched chain, or cyclic (in which case, it would also be known as a "cycloalkenyl") hydrocarbon containing from 2-10 carbons and containing at least one carbon-carbon double bond formed by the removal of two hydrogens. In some embodiments, depending on the structure, an alkenyl group is a monoradical or a diradical (e.g., an alkenylene group). In some embodiments, alkenyl groups are optionally substituted. Examples of alkenyl include, but are not limited to, ethenyl, 2-propenyl, 2-methyl-2-propenyl, 3-butenyl, 4-pentenyl, 5-hexenyl, 2-heptenyl, and 2-methyl-1-heptenyl. In certain embodiments, alkenyl groups are optionally substituted.

The term "$C_{2-6}$ alkenyl," as used herein, means a straight, branched chain, or cyclic (in this case, it would also be known as "cycloalkyl") hydrocarbon containing from 2-6 carbon atoms and at least one carbon-carbon double bond formed by the removal of two hydrogens.

The term "alkoxy," as used herein, means an alkyl group, as defined herein, appended to the parent molecular moiety through an oxygen atom. Examples of alkoxy include, but are not limited to, methoxy, ethoxy, propoxy, 2-propoxy, butoxy, tert-butoxy, pentyloxy, and hexyloxy.

An "amino acid" (or AA) or amino acid residue include but are not limited to the 20 naturally occurring amino acids commonly designated by three letter symbols and also includes 4-hydroxyproline, hydroxylysine, demosine, isodemosine, 3-methylhistidine, norvalin, beta-alanine, gamma-aminobutyric acid, homocysteine, homoserine, ornithine and methionine sulfone. The amino acid residue of the present application also include the corresponding N-methyl amino acids, such as —N(CH$_3$)CH$_2$C(O)O—, —NHC(O)CH$_2$CH$_2$CH(NHCH$_3$)C(O)O—, etc. The amino acids, dipeptides, tripeptides, oligomers and polypeptides designated as -(AA)$_r$- of the present application may include the corresponding non-N-alkylated amino acids and peptides (such as non-N-methylated amino acids in the peptides), as well as a mixture of the non-N-alkylated amino acids and the N-alkylated amino acids of the peptides.

An "antibody-drug conjugate" or "ADC" is an antibody that is conjugated to one or more cytotoxins, through one or more linkers. An antibody-drug conjugate (ADC) may be of the formula A-L-CTX, wherein A is an antibody, L is a linker, and CTX is a cytotoxin.

In the context of a polypeptide, the term "analog" as used herein refers to a polypeptide that possesses a similar or identical function as a C10orf54 polypeptide, a fragment of a C10orf54 polypeptide, or an anti-C10orf54 antibody but does not necessarily comprise a similar or identical amino acid sequence of a C10orf54 polypeptide, a fragment of a C10orf54 polypeptide, or an anti-C10orf54 antibody, or possess a similar or identical structure of a C10orf54 polypeptide, a fragment of a C10orf54 polypeptide, or an anti-C10orf54 antibody. A polypeptide that has a similar amino acid sequence refers to a polypeptide that satisfies at least one of the following: (a) a polypeptide having an amino acid sequence that is at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical to the amino acid sequence of a C10orf54 polypeptide (e.g., SEQ ID NO:1079), a fragment of a C10orf54 polypeptide, or an anti-C10orf54 antibody described herein; (b) a polypeptide encoded by a nucleotide sequence that hybridizes under stringent conditions to a nucleotide sequence encoding a C10orf54 polypeptide, a fragment of a C10orf54 polypeptide, or an anti-C10orf54 antibody (or VH or VL region thereof) described herein of at least 5 amino acid residues, at least 10 amino acid residues, at least 15 amino acid residues, at least 20 amino acid residues, at least 25 amino acid residues, at least 40 amino acid residues, at least 50 amino acid residues, at least 60 amino acid residues, at least 70 amino acid residues, at least 80 amino acid residues, at least 90 amino acid residues, at least 100 amino acid residues, at least 125 amino acid residues, or at least 150 amino acid residues (see, e.g., Sambrook et al. (2001) *Molecular Cloning: A Laboratory Manual*, Cold Spring Harbor Laboratory Press, Cold Spring Harbor, N.Y.; Maniatis et al. (1982) *Molecular Cloning: A Laboratory Manual*, Cold Spring Harbor Press, Cold Spring Harbor, N.Y.); and (c) a polypeptide encoded by a nucleotide sequence that is at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical to the nucleotide sequence encoding a C10orf54 polypeptide, a fragment of a C10orf54 polypeptide, or an anti-C10orf54 antibody (or VH or VL region thereof) described herein. A polypeptide with similar structure to a C10orf54 polypeptide, a fragment of a C10orf54 polypeptide, or an anti-C10orf54 antibody described herein refers to a polypeptide that has a similar secondary, tertiary or quaternary structure of a C10orf54 polypeptide, a fragment of a C10orf54, or a C10orf54 antibody described herein. The structure of a polypeptide can determined by methods known to those skilled in the art, including but not limited to, X-ray crystallography, nuclear magnetic resonance, and crystallographic electron microscopy.

As used herein, an "antagonist" or "inhibitor" of C10orf54 refers to a molecule that is capable of inhibiting or otherwise decreasing one or more of the biological activities of C10orf54, such as in a cell expressing C10orf54 or in a cell expressing a C10orf54 ligand, such as a C10orf54 receptor. In some embodiments, an antagonist of C10orf54 (e.g., an antagonistic antibody provided herein) may, for example, act by inhibiting or otherwise decreasing the activation and/or cell signaling pathways of the cell expressing a C10orf54 or a C10orf54 receptor, thereby inhibiting a C10orf54-mediated biological activity of the cell the relative to the C10orf54-mediated biological activity in the absence of antagonist. In certain embodiments the antibodies provided herein are antagonistic anti-C10orf54 antibodies.

The terms "antibody" and "immunoglobulin" or "Ig" are used interchangeably herein, and are intended to include a polypeptide product of B cells within the immunoglobulin class of polypeptides that is able to bind to a specific molecular antigen and is composed of two identical pairs of polypeptide chains, wherein each pair has one heavy chain (about 50-70 kDa) and one light chain (about 25 kDa) and each amino-terminal portion of each chain includes a variable region of about 100 to about 130 or more amino acids and each carboxy-terminal portion of each chain includes a constant region (See, Borrebaeck (ed.) (1995) *Antibody Engineering*, Second Ed., Oxford University Press.; Kuby (1997) *Immunology*, Third Ed., W.H. Freeman and Company, New York). In specific embodiments, the specific molecular antigen can be bound by an antibody provided herein includes the target C10orf54 polypeptide, fragment or epitope.

Antibodies also include, but are not limited to, synthetic antibodies, monoclonal antibodies, recombinantly produced antibodies, multispecific antibodies (including bi-specific antibodies), human antibodies, humanized antibodies, camelized antibodies, chimeric antibodies, intrabodies, anti-idiotypic (anti-Id) antibodies, and functional fragments of any of the above, which refers a portion of an antibody heavy or light chain polypeptide that retains some or all of the binding activity of the antibody from which the fragment was derived. Non-limiting examples of functional fragments include single-chain Fvs (scFv) (e.g., including monospecific, bispecific, etc.), Fab fragments, F(ab') fragments, F(ab)$_2$ fragments, F(ab')$_2$ fragments, disulfide-linked Fvs (sdFv), Fd fragments, Fv fragments, diabody, triabody, tetrabody and minibody. In particular, antibodies provided herein include immunoglobulin molecules and immunologically active portions of immunoglobulin molecules, e.g., antigen binding domains or molecules that contain an antigen-binding site that binds to a C10orf54 antigen (e.g., one or more complementarity determining regions (CDRs) of an anti-C10orf54 antibody). Such antibody fragments can be found described in, for example, Harlow and Lane, *Antibodies: A Laboratory Manual*, Cold Spring Harbor Laboratory, New York (1989); Myers (ed.), *Molec. Biology and Biotechnology: A Comprehensive Desk Reference*, New York: VCH Publisher, Inc.; Huston et al., *Cell Biophysics*, 22:189-224 (1993); Plückthun and Skerra, *Meth. Enzymol.*, 178:497-515 (1989) and in Day, E.D., Advanced Immunochemistry, Second Ed., Wiley-Liss, Inc., New York, N.Y. (1990). The antibodies provided herein can be of any type (e.g., IgG, IgE, IgM, IgD, IgA and IgY), any class (e.g., IgG1, IgG2, IgG3, IgG4, IgA1 and IgA2), or any subclass (e.g., IgG2a and IgG2b) of immunoglobulin molecule. An anti-C10orf54 antibodies provided herein can be agonistic antibodies or antagonistic antibodies.

The terms "antibodies that specifically bind to C10orf54," "antibodies that specifically bind to a C10orf54 epitope," "anti-C10orf54 antibodies" and analogous terms are also used interchangeably herein and refer to antibodies that specifically bind to a C10orf54 polypeptide, such as a C10orf54 antigen or epitope. Such antibodies include humanized antibodies. An antibody that specifically binds to a C10orf54 antigen may be cross-reactive with related antigens. In certain embodiments, an antibody that specifically binds to a C10orf54 antigen does not cross-react with other antigens. An antibody that specifically binds to a C10orf54 antigen can be identified, for example, by immunoassays, BIAcore, or other techniques known to those of skill in the art. An antibody binds specifically to a C10orf54 antigen when it binds to a C10orf54 antigen with higher affinity than to any cross-reactive antigen as determined using experimental techniques, such as radioimmunoassays (RIA) and enzyme-linked immunosorbent assays (ELISAs). Typically a specific or selective reaction will be at least twice background signal or noise and more typically more than 10 times background. See, e.g., Paul, ed., 1989, *Fundamental Immunology Second Edition*, Raven Press, New York at pages 332-336 for a discussion regarding antibody specificity. In certain embodiments, an antibody "which binds" an antigen of interest is one that binds the antigen with sufficient affinity such that the antibody is useful as a diagnostic and/or therapeutic agent in targeting a cell or tissue expressing the antigen, and does not significantly cross-react with other proteins. In such embodiments, the extent of binding of the antibody to a "non-target" protein will be less than about 10% of the binding of the antibody to its particular target protein as determined by fluorescence activated cell sorting (FACS) analysis or radioimmunoprecipitation (RIA). With regard to the binding of an antibody to a target molecule, the term "specific binding" or "specifically binds to" or is "specific for" a particular polypeptide or an epitope on a particular polypeptide target means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target, for example, an excess of non-labeled target. In this case, specific binding is indicated if the binding of the labeled target to a probe is competitively inhibited by excess unlabeled target. The term "specific binding" or "specifically binds to" or is "specific for" a particular polypeptide or an epitope on a particular polypeptide target as used herein can be exhibited, for example, by a molecule having a Kd for the target of at least about $10^{-4}$ M, alternatively at least about $10^{-5}$ M, alternatively at least about $10^{-6}$ M, alternatively at least about $10^{-7}$ M, alternatively at least about $10^{-8}$ M, alternatively at least about $10^{-9}$ M, alternatively at least about $10^{-10}$ M, alternatively at least about $10^{-11}$ M, alternatively at least about $10^{-12}$ M, or greater. In one embodiment, the term "specific binding" refers to binding where a molecule binds to a particular polypeptide or epitope on a particular polypeptide without substantially binding to any other polypeptide or polypeptide epitope. In certain embodiments, an antibody that binds to C10orf54 has a dissociation constant (Kd) of ≤1 µM, ≤100 nM, ≤10 nM, ≤1 nM, or ≤0.1 nM. In certain embodiments, anti-C10orf54 antibody binds to an epitope of C10orf54 that is conserved among C10orf54 from different species.

An "anti-c10orf54 antibody" or "an antibody that binds to C10orf54" refers to an antibody that is capable of binding C10orf54, including, for example, an antibody, with sufficient affinity such that the antibody is useful as a diagnostic and/or therapeutic agent in targeting C10orf54. Such antibodies include humanized antibodies. Preferably, the extent of binding of an anti-C10orf54 antibody to an unrelated, non-C10orf54 protein is less than about 10% of the binding of the antibody to C10orf54 as measured, e.g., by fluorescence activated cell sorting (FACS) analysis or a radioimmunoassay (RIA). An antibody that "'specifically binds to" or is "specific for" C10orf54 is defined as above. In certain embodiments, an antibody that binds to C10orf54 has a dissociation constant (Kd) of <1 µM, <100 nM, <10 nM, <1 nM, or <0.1 nM. In certain embodiments, anti-C10orf54 antibody binds to an epitope of C10orf54 that is conserved among C10orf54 from different species.

An "antigen" is a predetermined antigen to which an antibody can selectively bind. The target antigen may be a polypeptide, carbohydrate, nucleic acid, lipid, hapten or other naturally occurring or synthetic compound. In specific embodiments, the target antigen is a polypeptide.

The term "antigen binding fragment," "antigen binding domain," "antigen binding region," and similar terms refer to that portion of an antibody which comprises the amino acid residues that interact with an antigen and confer on the binding agent its specificity and affinity for the antigen (e.g., the complementarity determining regions (CDRs)).

The terms "binds" or "binding" as used herein refer to an interaction between molecules to form a complex. Interactions can be, for example, non-covalent interactions including hydrogen bonds, ionic bonds, hydrophobic interactions, and/or van der Waals interactions. A complex can also include the binding of two or more molecules held together by covalent or non-covalent bonds, interactions or forces. The strength of the total non-covalent interactions between a single antigen-binding site on an antibody and a single epitope of a target molecule, such as C10orf54, is the affinity of the antibody or functional fragment for that epitope. The ratio of association ($k_1$) to dissociation ($k_{-1}$) of an antibody to a monovalent antigen ($k_1/k_{-1}$) is the association constant K, which is a measure of affinity. The value of K varies for different complexes of antibody and antigen and depends on both $k_1$ and $k_{-1}$. The association constant K for an antibody provided herein can be determined using any method provided herein or any other method well known to those skilled in the art. The affinity at one binding site does not always reflect the true strength of the interaction between an antibody and an antigen. When complex antigens containing multiple, repeating antigenic determinants, such as a polyvalent C10orf54, come in contact with antibodies containing multiple binding sites, the interaction of antibody with antigen at one site will increase the probability of a reaction at a second site. The strength of such multiple interactions between a multivalent antibody and antigen is called the avidity. The avidity of an antibody can be a better measure of its binding capacity than is the affinity of its individual binding sites. For example, high avidity can compensate for low affinity as is sometimes found for pentameric IgM antibodies, which can have a lower affinity than IgG, but the high avidity of IgM, resulting from its multivalence, enables it to bind antigen effectively.

The term "C10orf54" or "C10orf54 polypeptide" and similar terms refers to the polypeptide ("polypeptide," "peptide" and "protein" are used interchangeably herein) encoded by the human Chromosome 10 Open Reading Frame 54 (C10orf54) gene, which is also known in the art as B7-H5, platelet receptor Gi24, GI24, Stress Induced Secreted Protein1, SISP1, and PP2135, comprising the amino acid sequence of:

(SEQ ID NO: 1079)

```
  1 mgvptaleag swrwgsllfa lflaaslgpv aafkvatpys lyvcpegqnv tltcrllgpv
 61 dkghdvtfyk twyrssrgev qtcserrpir nltfqdlhlh hgghqaants hdlaqrhgle
121 sasdhhgnfs itmrnltlld sglycclvve irhhhsehrv hgamelqvqt gkdapsncvv
```

```
181 ypsssqdsen itaaalatga civgilclpl illlvykqrq aasnrraqel vrmdsniqgi 241 enpgfeaspp aqgipeakvr hplsyvaqrq psesgrhlls epstplsppg pgdvffpsld 301 pvpdspnfev I
``` and related polypeptides, including SNP variants thereof. The C10orf54 polypeptide has been shown to or is predicted to comprise several distinct regions within the amino acid sequence including: a signal sequence (residues 1-32; see Zhang et al., *Protein Sci.* 13:2819-2824 (2004)); an immunoglobulin domain—IgV-like (residues 33-162); and a transmembrane region (residues 195-215). The mature C10orf54 protein includes amino acid residues 33-311 of SEQ ID NO: 1079. The extracellular domain of the C10orf54 protein includes amino acid residues 33-194 of SEQ ID NO: 1079. Related polypeptides include allelic variants (e.g., SNP variants); splice variants; fragments; derivatives; substitution, deletion, and insertion variants; fusion polypeptides (e.g., chimeric proteins); and interspecies homologs, preferably, which retain C10orf54 activity and/or are sufficient to generate an anti-C10orf54 immune response. As those skilled in the art will appreciate, an anti-C10orf54 antibody provided herein can bind to a C10orf54 polypeptide, polypeptide fragment, antigen, and/or epitope, as an epitope is part of the larger antigen, which is part of the larger polypeptide fragment, which, in turn, is part of the larger polypeptide. C10orf54 can exist in a native or denatured form. The C10orf54 polypeptides described herein may be isolated from a variety of sources, such as from human tissue types or from another source, or prepared by recombinant or synthetic methods. A "native sequence C10orf54 polypeptide" comprises a polypeptide having the same amino acid sequence as the corresponding C10orf54 polypeptide derived from nature. Such native sequence C10orf54 polypeptides can be isolated from nature or can be produced by recombinant or synthetic means. The term "native sequence C10orf54 polypeptide" specifically encompasses naturally-occurring truncated or secreted forms of the specific C10orf54 polypeptide (e.g., an extracellular domain sequence), naturally-occurring variant forms (e.g., alternatively spliced forms) and naturally-occurring allelic variants of the polypeptide.

A cDNA nucleic acid sequence encoding the C10orf54 polypeptide comprises:

```
(SEQ ID NO: 1080)
  1 atgggcgtcc ccacggccct ggaggccggc agctggcgct ggggatccct gctcttcgct 61 ctcttcctgg ctgcgtccct aggtccggtg gcagccttca aggtcgccac gccgtattcc 121 ctgtatgtct gtcccgaggg gcagaacgtc accctcacct gcaggctctt gggccctgtg 181 gacaaagggc acgatgtgac cttctacaag acgtggtacc gcagctcgag gggcgaggtg 241 cagacctgct cagagcgccg gcccatccgc aacctcacgt tccaggacct tcacctgcac 301 catggaggcc accaggctgc caacaccagc cacgacctgg ctcagcgcca cgggctggag 361 tcggcctccg accaccatgg caacttctcc atcaccatgc gcaacctgac cctgctggat 421 agcggcctct actgctgcct ggtggtggag atcaggcacc accactcgga gcacagggtc 481 catggtgcca tggagctgca ggtgcagaca ggcaaagatg caccatccaa ctgtgtggtg 541 tacccatcct cctcccagga tagtgaaaac atcacggctg cagccctggc tacgggtgcc 601 tgcatcgtag aatcctctg cctccccctc atcctgctcc tggtctacaa gcaaaggcag 661 gcagcctcca accgccgtgc ccaggagctg gtgcggatgg acagcaacat tcaagggatt 721 gaaaacccg gctttgaagc ctcaccacct gcccagggga tacccgaggc caaagtcagg 781 caccccctgt cctatgtggc ccagcggcag ccttctgagt ctgggcggca tctgctttcg 841 gagcccagca ccccctgtc tcctccagge cccggagacg tcttcttccc atccctggac 901 cctgtccctg actctccaaa ctttgaggtc atctag
```

Orthologs to the C10orf54 polypeptide are also well known in the art. For example, the mouse ortholog to the C10orf54 polypeptide is V-region Immunoglobulin-containing Suppressor of T cell Activation (VISTA) (also known as PD-L3, PD-1H, PD-XL, Pro1412 and UNQ730), which shares approximately 70% sequence identity to the human polypeptide. Orthologs of C10orf54 can also be found in additional organisms including chimpanzee, cow, rat and zebrafish.

A "C10orf54-expressing cell," "a cell having expression of C10orf54" or a grammatical equivalent thereof refers to a cell that expresses endogenous or transfected C10orf54 on the cell surface. C10orf54 expressing cells include a C10orf54-berring tumor cells, regulatory tumor cells (e.g., CD4$^+$ Foxp3$^+$ regulatory T cells), myeloid-derived suppressor cells (e.g., CD11b$^+$ or CD11b$^{high}$ myeloid-derived suppressor cells) and/or suppressive dendritic cells (e.g., CD11 b$^+$ or CD11b$^{high}$ dendritic cells). A cell expressing C10orf54 produces sufficient levels of C10orf54 on its surface, such that an anti-C10orf54 antibody can bind thereto. In some aspect, such binding may have a therapeutic effect with respect to the cancer. A cell that "overexpresses" C10orf54 is one that has significantly higher levels of C10orf54 at the cell surface thereof, compared to a cell of the same tissue type that is known to express C10orf54. Such overexpression may be caused by gene amplification or by increased transcription or translation. C10orf54 overexpression may be determined in a diagnostic or prognostic assay by evaluating increased levels of the C10orf54 protein present on the surface of a cell (e.g. via an immunohistochemistry assay; FACS analysis). Alternatively, or additionally, one may measure levels of C10orf54-encoding nucleic acid or mRNA in the cell, e.g. via fluorescent in situ hybridization; (FISH; see WO98/45479 published October, 1998), Southern blotting, Northern blotting, or polymerase chain reaction (PCR) techniques, such as real time quantitative PCR (RT-PCR). Aside from the above assays, various in vivo assays are available to the skilled practitioner. For example, one may expose cells within the body of the patient to an antibody which is optionally labeled with a detectable agent, and binding of the antibody to cells in the patient can be evaluated, e.g. by external scanning for radioactivity or by analyzing a biopsy taken from a patient previously exposed to the antibody. A C10orf54-expressing tumor cell includes, but is not limited to, acute myeloid leukemia (AML) tumor cells.

A "C10orf54-mediated disease," "C10orf54-mediated disorder" and "C10orf54-mediated condition" are used interchangeably and refer to any disease, disorder or condition that is completely or partially caused by or is the result of C10orf54. Such diseases, disorders or conditions include those caused by or otherwise associated with C10orf54, including by or associated with C10orf54-expressing cells (e.g., tumor cells, myeloid-derived suppressor cells (MDSC), suppressive dendritic cells (suppressive DC), and/or regulatory T cells (T regs)). In certain embodiments, C10orf54 is aberrantly (e.g., highly) expressed on the surface of a cell. In some embodiments, C10orf54 may be aberrantly upregulated on a particular cell type. In other embodiments, normal, aberrant or excessive cell signaling is caused by binding of C10orf54 to a C10orf54 ligand, which can bind or otherwise interact with C10orf54.

The terms "cell proliferative disorder" and "proliferative disorder" refer to disorders that are associated with some degree of abnormal cell proliferation. In one embodiment, the cell proliferative disorder is a tumor or cancer. "Tumor," as used herein, refers to all neoplastic cell growth and proliferation, whether malignant or benign, and all pre-cancerous and cancerous cells and tissues. The terms "cancer," "cancerous," "cell proliferative disorder," "proliferative disorder" and "tumor" are not mutually exclusive as referred to herein. The terms "cancer" and "cancerous" refer to or describe the physiological condition in mammals that is typically characterized by unregulated cell growth. Examples of cancer include, but are not limited to, carcinoma, lymphoma, blastoma, sarcoma, and leukemia or lymphoid malignancies. More particular examples of such cancers include squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, oral cancer, liver cancer, bladder cancer, cancer of the urinary tract, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, melanoma, multiple myeloma and B-cell lymphoma, brain cancer, skin cancer, esophagus cancer as well as head and neck cancer, and associated metastases.

The term "carrier" refers to a diluent, adjuvant (e.g., Freund's adjuvant (complete and incomplete)), excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a exemplary carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in *Remington's Pharmaceutical Sciences* (1990) Mack Publishing Co., Easton, Pa. Such compositions will contain a prophylactically or therapeutically effective amount of the antibody, e.g., in isolated or purified form, together with a suitable amount of carrier so as to provide the form for proper administration to the patient. The formulation should suit the mode of administration.

The term "chemical group," as used herein, refers to two or more atoms bound together as a single unit and forming part of a molecule.

A "chemotherapeutic agent" is a chemical agent (e.g., compound or drug) useful in the treatment of cancer, regardless of mechanism of action. Chemotherapeutic agents include compounds used in targeted therapy and conventional chemotherapy. Examples of chemotherapeutic agents include, but are not limited to, alkylating agents such as thiotepa and CYTOXAN® cyclophosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); delta-9-tetrahydrocannabinol (dronabinol, AR1NOL®); beta-lapachone; lapachol; colchicines; betulinic acid; a camptothecin (including the synthetic analogue topotecan (HYCAMTIN®), CPT-11 (irinotecan, CAMPTOSAR®), acetylcamptothecin, scopolectin, and 9-aminocamptothecin); bryostatin; callystatin; CC-1065 (including its adozelesin, carzelesin and bizelesin synthetic analogues); podophyllotoxin; podophyllinic acid; teniposide; cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gammal I and calicheamicin omega II (see, e.g., Agnew, *Chem Intl. Ed. Engl.* 33:183-186 (1994)); dynemicin, including dynemicin A; an esperamicin; as well as neocarzinostatin chromophore and related chromoprotein enediyne antiobiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN®, doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; am inolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine (ELDISINE®, FILDESIN®); dacarbazine; mannomustine; mitobronitol; mitolactol; pipobroman; gacytosine; arabinoside ("Ara-C"); thiotepa; taxoids, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; gemcitabine (GEMZAR®); 6-thioguanine; mercaptopurine; methotrexate; platinum analogs such as cisplatin and carboplatin; vinblastine (VELBAN®); platinum; etoposide (VP-16); ifosfamide; mitoxantrone; vincristine (ONCOVIN®); oxaliplatin; leucovovin; vinorelbine (NAVELBINE®); novantrone; edatrexate; daunomycin; am inopterin; ibandronate; topoisomerase inhibitor RFS 2000; difluoromethylornithine (DMFO); retinoids such as retinoic acid; capecitabine (XELODA®); pharmaceutically acceptable salts, acids or derivatives of any of the above; as well as combinations of two or more of the above such as CHOP, an abbreviation for a combined therapy of cyclophosphamide, doxorubicin, vincristine, and prednisolone, and FOLFOX, an abbreviation for a treatment regimen with oxaliplatin (ELOXATIN™) combined with 5-FU and leucovovin. Additional chemotherapeutic agents include cytotoxic agents useful as antibody drug conjugates, such as maytansinoids (DM1 and DM4, for example) and auristatins (MMAE and MMAF, for example).

Also included in the definition of chemotherapeutic agent are: (i) anti-hormonal agents that act to regulate or inhibit hormone action on tumors such as anti-estrogens and selective estrogen receptor modulators (SERMs), including, for example, tamoxifen (including NOLVADEX®; tamoxifen citrate), raloxifene, droloxifene, 4-hydroxytamoxifen, trioxifene, keoxifene, LY 117018, onapristone, and FARESTON® (toremifine citrate); (ii) aromatase inhibitors that inhibit the enzyme aromatase, which regulates estrogen production in the adrenal glands, such as, for example, 4(5)-imidazoles, aminoglutethimide, MEGASE® (megestrol acetate), AROMASIN® (exemestane; Pfizer), formestanie, fadrozole, RI VISor® (vorozole), FEMARA® (letrozole; Novartis), and ARIMIDEX® (anastrozole; AstraZeneca); (iii) anti-androgens such as flutamide, nilutamide, bicalutamide, leuprolide, and goserelin; as well as troxacitabine (a 1,3-dioxolane nucleoside cytosine analog); (iv) protein kinase inhibitors such as ME inhibitors (WO 2007/044515); (v) lipid kinase inhibitors; (vi) antisense oligonucleotides, particularly those which inhibit expression of genes in signaling pathways implicated in aberrant cell proliferation, for example, PKC-alpha, Raf and H-Ras, such as oblimersen (GENASENSE®, Genta Inc.); (vii) ribozymes such as VEGF expression inhibitors (e.g., ANGIOZYME®) and HER2 expression inhibitors; (viii) vaccines such as gene therapy vaccines, for example, ALLOVECTIN®, LEUVECTIN®, and VAX1D®); PROLEUKIN® rIL-2; topoisomerase 1 inhibitors such as LURTOTECAN®; ABARELIX® rmRH; (ix) anti-angiogenic agents such as bevacizumab (AVASTIN®, Genentech); and pharmaceutically acceptable salts, acids and derivatives of any of the above The antibodies provided herein can include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see U.S. Pat. No. 4,816,567; and Morrison et al., *Proc. Natl. Acad. Sci. USA*, 81:6851-6855 (1984)).

As used herein, the term "composition" is intended to encompass a product containing the specified ingredients (e.g., an antibody provided herein) in, optionally, the specified amounts, as well as any product which results, directly or indirectly, from combination of the specified ingredients in, optionally, the specified amounts.

A "CDR" refers to one of three hypervariable regions (H1, H2 or H3) within the non-framework region of the immunoglobulin (Ig or antibody) VH β-sheet framework, or one of three hypervariable regions (L1, L2 or L3) within the non-framework region of the antibody VL β-sheet framework. Accordingly, CDRs are variable region sequences interspersed within the framework region sequences. CDR regions are well known to those skilled in the art and have been defined by, for example, Kabat as the regions of most hypervariability within the antibody variable (V) domains (Kabat et al., *J. Biol. Chem.* 252:6609-6616 (1977); Kabat, *Adv. Prot. Chem.* 32:1-75 (1978)). CDR region sequences also have been defined structurally by Chothia as those residues that are not part of the conserved β-sheet framework, and thus are able to adapt different conformations (Chothia and Lesk, *J. Mol. Biol.* 196:901-917 (1987)). Both terminologies are well recognized in the art. CDR region sequences have also been defined by AbM, Contact and IMGT. CDR region sequences are illustrated in FIGS. 16A and 16B. The positions of CDRs within a canonical antibody variable domain have been determined by comparison of numerous structures (Al-Lazikani et al., *J. Mol. Biol.* 273: 927-948 (1997); Morea et al., *Methods* 20:267-279 (2000)). Because the number of residues within a hypervariable region varies in different antibodies, additional residues relative to the canonical positions are conventionally numbered with a, b, c and so forth next to the residue number in the canonical variable domain numbering scheme (Al-Lazikani et al., supra (1997)). Such nomenclature is similarly well known to those skilled in the art.

The term "hypervariable region", "HVR", or "HV", when used herein refers to the regions of an antibody variable domain that are hypervariable in sequence and/or form structurally defined loops. Generally, antibodies comprise six hypervariable regions; three in the VH (H1, H2, H3), and three in the VL (L1, L2, L3). A number of hypervariable region delineations are in use and are encompassed herein. The Kabat CDRs are based on sequence variability and are the most commonly used (Kabat et al., *Sequences of Proteins of Immunological Interest*, 5th Ed. Public Health Service, National Institutes of Health, Bethesda, Md. (1991)). Chothia refers instead to the location of the structural loops (Chothia and Lesk *J Mol. Bioi.* 196:901-917 (1987)). The end of the Chothia CDR-HI loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34). The AbM hypervariable regions represent a compromise between the Kabat CDRs and Chothia structural loops, and are used by Oxford Molecular's AbM antibody modeling software. The "contact" hypervariable regions are based on an analysis of the available complex crystal structures. The residues from each of these hypervariable regions are noted below.

Recently, a universal numbering system has been developed and widely adopted, ImMunoGeneTics (IMGT) Information System® (Lafranc et al., *Dev. Comp. Immunol.* 27(1):55-77 (2003)). IMGT is an integrated information system specializing in immunoglobulins (IG), T cell receptors (TR) and major histocompatibility complex (MHC) of human and other vertebrates. Herein, the CDRs are referred to in terms of both the amino acid sequence and the location within the light or heavy chain. As the "location" of the CDRs within the structure of the immunoglobulin variable domain is conserved between species and present in structures called loops, by using numbering systems that align variable domain sequences according to structural features, CDR and framework residues and are readily identified. This information can be used in grafting and replacement of CDR residues from immunoglobulins of one species into an acceptor framework from, typically, a human antibody. Correspondence between the Kabat numbering and the IMGT unique numbering system is also well known to one skilled in the art (e.g. Lefranc et al., supra) and is also illustrated in FIGS. 16A and 16B. An Exemplary system, shown herein, combines Kabat and Chothia.

TABLE 1

CDR Definitions

| | Exemplary (Kabat + Chothia) | IMGT | Kabat | AbM | Chothia | Contact |
|---|---|---|---|---|---|---|
| $V_H$ CDR1 | 26-35 | 27-38 | 31-35 | 26-35 | 26-32 | 30-35 |
| $V_H$ CDR2 | 50-65 | 56-65 | 50-65 | 50-58 | 53-55 | 47-58 |
| $V_H$ CDR3 | 95-102 | 105-117 | 95-102 | 95-102 | 96-101 | 93-101 |
| $V_L$ CDR1 | 24-34 | 27-38 | 24-34 | 24-34 | 26-32 | 30-36 |
| $V_L$ CDR2 | 50-56 | 56-65 | 50-56 | 50-56 | 50-52 | 46-55 |
| $V_L$ CDR3 | 89-97 | 105-117 | 89-97 | 89-97 | 91-96 | 89-96 |

Hypervariable regions may comprise "extended hypervariable regions" as follows: 24-36 or 24-34 (LI), 46-56 or 50-56 (L2) and 89-97 or 89-96 (L3) in the VL and 26-35 or 26-35A (H1), 50-65 or 49-65 (H2) and 93-102, 94-1 02, or 95-102 (H3) in the VH. The variable domain residues are numbered according to Kabat et al., supra, for each of these definitions. As used herein, the terms "HVR" and "CDR" are used interchangeably.

The term "constant region" or "constant domain" refers to a carboxy terminal portion of the light and heavy chain which is not directly involved in binding of the antibody to antigen but exhibits various effector function, such as interaction with the Fc receptor. The terms refer to the portion of an immunoglobulin molecule having a more conserved amino acid sequence relative to the other portion of the immunoglobulin, the variable domain, which contains the antigen binding site. The constant domain contains the CH1, CH2 and CH3 domains of the heavy chain and the CL domain of the light chain.

The term "cycloalkyl," as used herein, means a monocyclic or polycyclic radical that contains only carbon and hydrogen, and includes those that are saturated, partially unsaturated, or fully unsaturated. Cycloalkyl groups include groups having from 3 to 10 ring atoms.

In the context of a polypeptide, the term "derivative" as used herein refers to a polypeptide that comprises an amino acid sequence of a C10orf54 polypeptide, a fragment of a C10orf54 polypeptide, or an antibody that binds to a C10orf54 polypeptide which has been altered by the introduction of amino acid residue substitutions, deletions or additions. The term "derivative" as used herein also refers to a C10orf54 polypeptide, a fragment of a C10orf54 polypeptide, or an antibody that binds to a C10orf54 polypeptide which has been chemically modified, e.g., by the covalent attachment of any type of molecule to the polypeptide. For example, but not by way of limitation, a C10orf54 polypeptide, a fragment of a C10orf54 polypeptide, or a C10orf54 antibody may be chemically modified, e.g., by glycosylation, acetylation, pegylation, phosphorylation, amidation, derivatization by known protecting/blocking groups, proteolytic cleavage, linkage to a cellular ligand or other protein, etc. The derivatives are modified in a manner that is different from naturally occurring or starting peptide or polypeptides, either in the type or location of the molecules attached. Derivatives further include deletion of one or more chemical groups which are naturally present on the peptide or polypeptide. A derivative of a C10orf54 polypeptide, a fragment of a C10orf54 polypeptide, or a C10orf54 antibody may be chemically modified by chemical modifications using techniques known to those of skill in the art, including, but not limited to specific chemical cleavage, acetylation, formulation, metabolic synthesis of tunicamycin, etc. Further, a derivative of a C10orf54 polypeptide, a fragment of a C10orf54 polypeptide, or a C10orf54 antibody may contain one or more non-classical amino acids. A polypeptide derivative possesses a similar or identical function as a C10orf54 polypeptide, a fragment of a C10orf54 polypeptide, or a C10orf54 antibody described herein.

The term "cytotoxic agent" or "cytotoxin" or "CTX" as used herein refers to a substance that inhibits or prevents the function of cells and/or has a cytotoxic effect on cells (e.g., causes destruction of cells). The term is intended to include alkylating agents, an anthracyclines, a cytoskeletal disruptors (taxanes), an epothilones, an histone deacetylase Inhibitor (HDAC), an inhibitor of Topoisomerase I, an Inhibitor of Topoisomerase II, a kinase inhibitor, a monoclonal antibodies, a nucleotide analog, a peptide antibiotic, a platinum-based agent, a retinoids, a Vinca alkaloid or a derivative thereof, and radioisotope. The term is also intended to include Actinomycin, all-trans retinoic acid, Azacitidine, Azathioprine, Bleomycin, Bortezomib, Carboplatin, Capecitabine, Cisplatin, Chlorambucil, Cyclophosphamide, Cytarabine, Daunorubicin, Docetaxel, Doxifluridine, Doxorubicin, Epirubicin, Epothilone, Etoposide, Fluorouracil, Gemcitabine, Hydroxyurea, Idarubicin, Imatinib, Irinotecan, Mechlorethamine, Mercaptopurine, Methotrexate, Mitoxantrone, Oxaliplatin, Paclitaxel, Pemetrexed, Teniposide, Tioguanine, Topotecan, Valrubicin, Vinblastine, Vincristine, Vindesine, and Vinorelbine. The term is also intended to include a tubulin stabilizer, a tubulin destabilizer, a DNA alkylator, a DNA minor groove binder, a DNA intercalator, a topoisomerase I inhibitor, a topoisomerase II inhibitor, a gyrase inhibitor, a protein synthesis inhibitor, a proteosome inhibitor, and an anti-metabolite. The term is also intended to include Actinomycin D, Amonafide, an auristatin, benzophenone, benzothiazole, a calicheamicin, Camptothecin, CC-1065 (NSC 298223), Cemadotin, Colchicine, Combretastatin A4, Dolastatin, Doxorubicin, Elinafide, Emtansine (DM1), Etoposide, KF-12347 (Leinamycin), a maytansinoid, Methotrexate, Mitoxantrone, Nocodazole, Proteosome Inhibitor 1 (PSI 1), Roridin A, T-2 Toxin (trichothecene analog), Taxol, a tubulysin, Velcade®, and Vincristine. Preferred cytotoxins include an auristatin, a calicheamicin, a maytansinoid, and a tubulysin. Other preferred cytotoxins include monomethylauristatin E (MMAE), monomethylauristatin F (MMAF), calicheamicin γ, mertansine, tubulysin T3, and tubulysin T4. Still other preferred cytotoxins include calicheamicin, doxorubicin, camptothecin, duocarmycin, DM1, DM4, a maytansinoid, and a tubulysin. Still other preferred cytotoxins include MMAE, MMAF, and a pyrrolobenzodiazepine (PBD).

The term "MMAF" generally refers to monomethylauristatin F, for which a chemical name is (S)-2-((2R,3R)-3-((S)-1-((3R,4S,5S)-4-((S)—N,3-dimethyl-2-((S)-3-methyl-2-(methylamino)butanamido)butanamido)-3-methoxy-5-methylheptanoyl)pyrrolidin-2-yl)-3-methoxy-2-methylpropanamido)-3-phenylpropanoic acid. A person of ordinary skill in the art will understand that MMAF is also described in the art as as MeVal-Val-Dil-Dap-Phe, where "Dil" is dolaisoleuine, and "Dap" is dolaproine.

The term "MMAE" generally refers to refers to monomethylauristatin E, for which a chemical name is (S)—N-((3R,4S,5S)-1-((S)-2-((1R,2R)-3-(((1S,2R)-1-hydroxy-1-phenylpropan-2-yl)amino)-1-methoxy-2-methyl-3-oxopropyl)pyrrolidin-1-yl)-3-methoxy-5-methyl-1-oxoheptan-4-yl)-N,3-dimethyl-2-((S)-3-methyl-2-(methylamino)butanamido)butanamide.

The term "pyrrolobenzodiazepine" or "pyrrolobenzodiazepines" generally refers to a family of pyrrolo[2,1-c][1,4] benzodiazepine (PBD) dimers which are synthetic sequence-selective interstrand DNA minor-groove cross-linking agents developed from anthramycins. Examples of pyrrolobenzodiazepines include, but are not limited to, abbeymycin, chicamycin, DC-81, mazethramycin, neothramycins A and B, porothramycin, prothracarcin, sibanomicin (DC-102), sibiromycin and tomamycin. Exemplary pyrrolobenzodiazepines include those disclosed in U.S. Pat. Nos. 7,049,311, 7,741,319, 8,697,688 (see, e.g., (26) in Example 5), and U.S. Pat. No. 8,765,740; International Publication Nos. WO 2011/130598 A1, WO 2012/112708 A1, WO 2013/055987 A1, WO 2013/165940 A1; and Jeffrey et al., Bioconjugate Chem. 2013, 24, 1256-1263, and Sutherland et al., Blood 2013, 122(8), 1455-1463; the content of each of which is incorporated by reference in its entirety.

The structures for T3 and T4 are provided below:

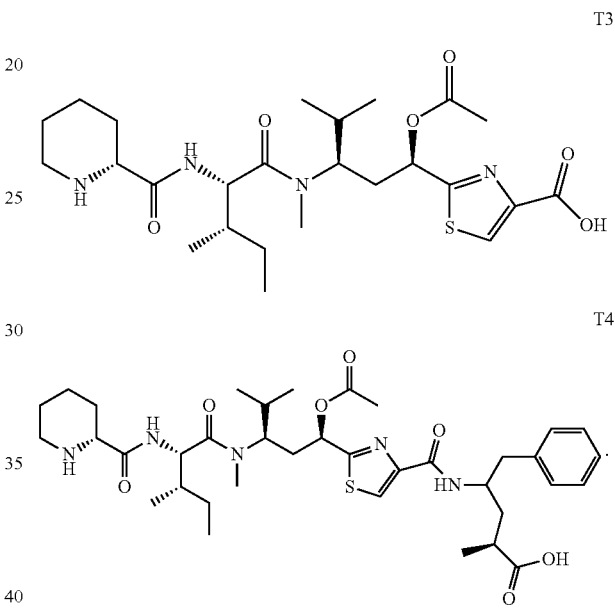

The structure for MMAF is provided below:

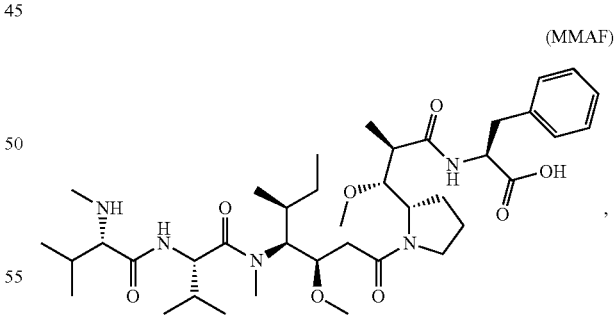

for which the chemical name is "(S)-2-((2R,3R)-3-((S)-1-((3R,4S,5S)-4-((S)—N,3-dimethyl-2-((S)-3-methyl-2-(methylamino)butanamido)butanamido)-3-methoxy-5-methylheptanoyl)pyrrolidin-2-yl)-3-methoxy-2-methylpropanamido)-3-phenylpropanoic acid." A person of ordinary skill in the art will understand that MMAF is also described in the art as as MeVal-Val-Dil-Dap-Phe, where "Dil" is dolaisoleuine, and "Dap" is dolaproine The structure for MMAE is provided below:

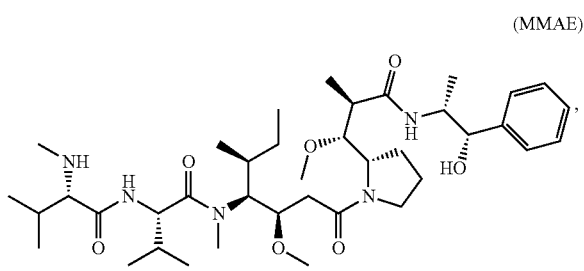 [SMILES: CC[C@H](C)[C@@H]([C@@H](CC(=O)N1CCC[C@H]1[C@H](OC)[C@@H](C)C(=O)N[C@H](C)[C@@H](O)c1ccccc1)OC)N(C)C(=O)[C@@H](NC(=O)[C@@H](NC)C(C)C)C(C)C]
(MMAE)

for which the chemical name is "(S)—N-((3R,4S,5S)-1-((S)-2-((1R,2R)-3-(((1S,2R)-1-hydroxy-1-phenylpropan-2-yl)amino)-1-methoxy-2-methyl-3-oxopropyl)pyrrolidin-1-yl)-3-methoxy-5-methyl-1-oxoheptan-4-yl)-N,3-dimethyl-2-((S)-3-methyl-2-(methylamino)butanamido)butanamide." A person of ordinary skill in the art will understand that MMAE is also described in the art as MeVal-Val-Dil-Dap-Norephedrine, where "Dil" is dolaisoleuine, and "Dap" is dolaproine.

The structures for three PBDs is provided below:

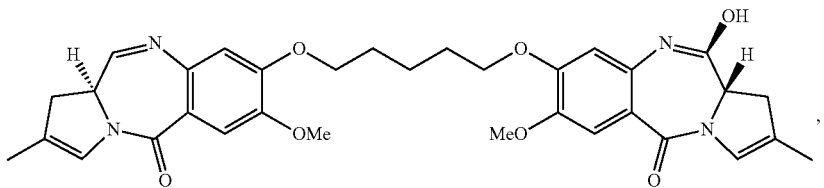

for which the chemical name is "(S)-11-hydroxy-7-methoxy-8-((5-(((S)-7-methoxy-2-methyl-5-oxo-5,11a-dihydro-1H-benzo[e]pyrrolo[1,2-a][1,4]diazepin-8-yl)oxy)pentyl)oxy)-2-methyl-1H-benzo[e]pyrrolo[1,2-a][1,4]diazepin-5(11aH)-one"; and

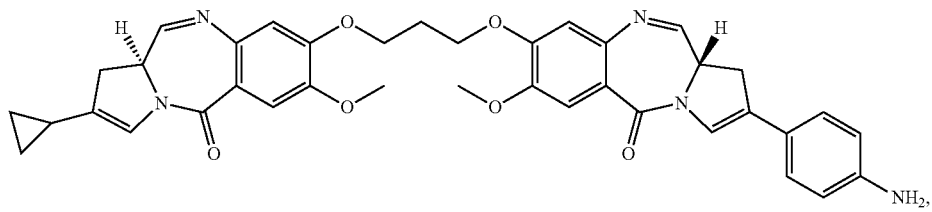 [SMILES: COc1cc2c(cc1OCCCOc1cc3c(cc1OC)C(=O)N1C=C(C4CC4)C[C@H]1C=N3)N=C[C@@H]1CC(c3ccc(N)cc3)=CN1C2=O]

for which the chemical name is "(S)-2-(4-aminophenyl)-8-(3-(((S)-2-cyclopropyl-7-methoxy-5-oxo-5,11a-dihydro-1H-benzo[e]pyrrolo[1,2-a][1,4]diazepin-8-yl)oxy)propoxy)-7-methoxy-1H-benzo[e]pyrrolo[1,2-a][1,4]diazepin-5(11aH)-one" (see, e.g., compound (26) in Example 5 of U.S. Pat. No. 8,697,688); and

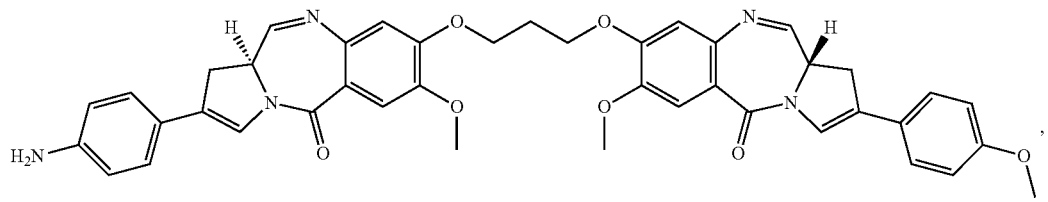 [SMILES: COc1ccc(C2=CN3C(=O)c4cc(OC)c(OCCCOc5cc6c(cc5OC)C(=O)N5C=C(c7ccc(N)cc7)C[C@H]5C=N6)cc4N=C[C@@H]3C2)cc1]

for which the chemical name is (S)-2-(4-aminophenyl)-7-methoxy-8-(3-(((S)-7-methoxy-2-(4-methoxyphenyl)-5-oxo-5,11a-dihydro-1H-benzo[e]pyrrolo[1,2-a][1,4]diazepin-8-yl)oxy)propoxy)-1H-benzo[e]pyrrolo[1,2-a][1,4]diazepin-5(11aH)-one.

Other cytotoxic agents including various antitumor or anticancer agents are known in the art.

The term "detectable probe," as used herein, refers to a composition that provides a detectable signal. The term includes, without limitation, any fluorophore, chromophore, radiolabel, enzyme, antibody or antibody fragment, and the like, that provide a detectable signal via its activity.

The term "diagnostic agent" refers to a substance administered to a subject that aids in the diagnosis of a disease. Such substances can be used to reveal, pinpoint, and/or define the localization of a disease causing process. In certain embodiments, a diagnostic agent includes a substance that is conjugated to an antibody provided herein, that when administered to a subject or contacted to a sample from a subject aids in the diagnosis of cancer, tumor formation, or any other C10orf54-mediated disease.

The term "detectable agent" refers to a substance that can be used to ascertain the existence or presence of a desired molecule, such as an antibody provided herein, in a sample or subject. A detectable agent can be a substance that is capable of being visualized or a substance that is otherwise able to be determined and/or measured (e.g., by quantitation).

An "effective amount" is an amount sufficient to effect beneficial or desired results. An effective amount can be administered in one or more administrations, applications or dosages. Such delivery is dependent on a number of variables including the time period for which the individual dosage unit is to be used, the bioavailability of the agent, the route of administration, etc. In some embodiments, effective amount also refers to the amount of an antibody provided herein to achieve a specified result (e.g., inhibition of a C10orf54 biological activity of a cell, such as modulating T cell activation and/or proliferation). In some embodiments, this term refers to the amount of a therapy (e.g., an antibody or pharmaceutical composition provided herein) which is sufficient to reduce and/or ameliorate the severity and/or duration of a given disease and/or a symptom related thereto. This term also encompasses an amount necessary for the reduction or amelioration of the advancement or progression of a given disease, reduction or amelioration of the recurrence, development or onset of a given disease, and/or to improve or enhance the prophylactic or therapeutic effect(s) of another therapy (e.g., a therapy other than anti-C10orf54 antibody provided herein). In some embodiments, the effective amount of an antibody is from about 0.1 mg/kg (mg of antibody per kg weight of the subject) to about 100 mg/kg. In certain embodiments, an effective amount of an antibody provided therein is about 0.1 mg/kg, about 0.5 mg/kg, about 1 mg/kg, 3 mg/kg, 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 60 mg/kg, about 70 mg/kg, about 80 mg/kg about 90 mg/kg or about 100 mg/kg (or a range therein).

The term "electrophilic leaving group," as used herein, refers to a leaving group that accepts an electron pair to make a covalent bond. In general, electrophiles are susceptible to attack by complementary nucleophiles, including the reduced thiols from the disulfide bond of an antibody.

The term "electrophilic leaving group that reacts selectively with thiols," as used herein, refers to electrophilic leaving group that reacts selectively with thiols, over other nucleophiles. In certain embodiments, an electrophilic leaving group that reacts selectively with thiols reacts selectively with the reduced thiols from the disulfide bond of an antibody.

The term "encode" or grammatical equivalents thereof as it is used in reference to nucleic acid molecule refers to a nucleic acid molecule in its native state or when manipulated by methods well known to those skilled in the art that can be transcribed to produce mRNA, which is then translated into a polypeptide and/or a fragment thereof. The antisense strand is the complement of such a nucleic acid molecule, and the encoding sequence can be deduced therefrom.

The term "epitope" as used herein refers to a localized region on the surface of an antigen, such as C10orf54 polypeptide or C10orf54 polypeptide fragment, that is capable of being bound to one or more antigen binding regions of an antibody, and that has antigenic or immunogenic activity in an animal, such as a mammal (e.g., a human), that is capable of eliciting an immune response. An epitope having immunogenic activity is a portion of a polypeptide that elicits an antibody response in an animal. An epitope having antigenic activity is a portion of a polypeptide to which an antibody binds as determined by any method well known in the art, for example, by an immunoassay. Antigenic epitopes need not necessarily be immunogenic. Epitopes usually consist of chemically active surface groupings of molecules such as amino acids or sugar side chains and have specific three dimensional structural characteristics as well as specific charge characteristics. A region of a polypeptide contributing to an epitope may be contiguous amino acids of the polypeptide or the epitope may come together from two or more non-contiguous regions of the polypeptide. The epitope may or may not be a three-dimensional surface feature of the antigen. In certain embodiments, a C10orf54 epitope is a three-dimensional surface feature of a C10orf54 polypeptide. In other embodiments, a C10orf54 epitope is linear feature of a C10orf54 polypeptide. Generally an antigen has several or many different epitopes and reacts with many different antibodies.

The term "excipient" as used herein refers to an inert substance which is commonly used as a diluent, vehicle, preservative, binder, or stabilizing agent, and includes, but not limited to, proteins (e.g., serum albumin, etc.), amino acids (e.g., aspartic acid, glutamic acid, lysine, arginine, glycine, histidine, etc.), fatty acids and phospholipids (e.g., alkyl sulfonates, caprylate, etc.), surfactants (e.g., SDS, polysorbate, nonionic surfactant, etc.), saccharides (e.g., sucrose, maltose, trehalose, etc.) and polyols (e.g., mannitol, sorbitol, etc.). See, also, *Remington's Pharmaceutical Sciences* (1990) Mack Publishing Co., Easton, Pa., which is hereby incorporated by reference in its entirety.

In the context of a peptide or polypeptide, the term "fragment" as used herein refers to a peptide or polypeptide that comprises less than the full length amino acid sequence. Such a fragment may arise, for example, from a truncation at the amino terminus, a truncation at the carboxy terminus, and/or an internal deletion of a residue(s) from the amino acid sequence. Fragments may, for example, result from alternative RNA splicing or from in vivo protease activity. In certain embodiments, C10orf54 fragments include polypeptides comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least 80 contiguous amino acid residues, at least 90 contiguous amino acid residues, at least contiguous 100 amino acid residues, at least 125 contiguous amino acid residues, at least 150 contiguous amino acid residues, at least 175 contiguous amino acid residues, at least 200 contiguous amino acid residues, or at least 250 contiguous amino acid residues of the amino acid sequence of a C10orf54 polypeptide or an antibody that binds to a C10orf54 polypeptide. In a specific embodiment, a fragment of a C10orf54 polypeptide or an antibody that binds to a C10orf54 antigen retains at least 1, at least 2, or at least 3 functions of the polypeptide or antibody.

The term "framework" or "FR" residues are those variable domain residues flanking the CDRs. FR residues are present, e.g., in chimeric, humanized, human, domain antibodies, diabodies, linear antibodies, and bispecific antibodies. FR residues are those variable domain residues other than the hypervariable region residues herein defined.

A "functional fragment" of an antibody will exhibit at least one if not some or all of the biological functions attributed to the intact antibody, the function comprising at least specific binding to the target antigen.

The term "fusion protein" as used herein refers to a polypeptide that comprises an amino acid sequence of an antibody and an amino acid sequence of a heterologous polypeptide or protein (e.g., a polypeptide or protein not normally a part of the antibody (e.g., a non-anti-C10orf54 antigen antibody)). The term "fusion" when used in relation to C10orf54 or to an anti-C10orf54 antibody refers to the joining of a peptide or polypeptide, or fragment, variant and/or derivative thereof, with a heterologous peptide or polypeptide. In certain embodiments, the fusion protein retains the biological activity of the C10orf54 or anti-C10orf54 antibody. In certain embodiments, the fusion protein comprises a C10orf54 antibody VH domain, VL domain, VH CDR (one, two or three VH CDRs), and/or VL CDR (one, two or three VL CDRs), wherein the fusion protein binds to a C10orf54 epitope.

The term "heavy chain" when used in reference to an antibody refers to a polypeptide chain of about 50-70 kDa, wherein the amino-terminal portion includes a variable region of about 120 to 130 or more amino acids and a carboxy-terminal portion that includes a constant region. The constant region can be one of five distinct types, referred to as alpha ($\alpha$), delta ($\delta$), epsilon ($\epsilon$), gamma ($\gamma$) and mu ($\mu$), based on the amino acid sequence of the heavy chain constant region. The distinct heavy chains differ in size: $\alpha$, $\delta$ and $\gamma$ contain approximately 450 amino acids, while p and c contain approximately 550 amino acids. When combined with a light chain, these distinct types of heavy chains give rise to five well known classes of antibodies, IgA, IgD, IgE, IgG and IgM, respectively, including four subclasses of IgG, namely IgG1, IgG2, IgG3 and IgG4. A heavy chain can be a human heavy chain.

The term "host" as used herein refers to an animal, such as a mammal (e.g., a human).

The term "host cell" as used herein refers to the particular subject cell transfected with a nucleic acid molecule and the progeny or potential progeny of such a cell. Progeny of such a cell may not be identical to the parent cell transfected with the nucleic acid molecule due to mutations or environmental influences that may occur in succeeding generations or integration of the nucleic acid molecule into the host cell genome.

"Humanized" forms of nonhuman (e.g., murine) antibodies are chimeric antibodies that include human immunoglobulins (recipient antibody) in which the native CDR residues are replaced by residues from the corresponding CDR of a nonhuman species (donor antibody) such as mouse, rat, rabbit or nonhuman primate having the desired specificity, affinity, and capacity. In some instances, one or more FR region residues of the human immunoglobulin are replaced by corresponding nonhuman residues. Furthermore, humanized antibodies can comprise residues that are not found in the recipient antibody or in the donor antibody. These modifications are made to further refine antibody performance. A humanized antibody heavy or light chain can comprise substantially all of at least one or more variable domains, in which all or substantially all of the CDRs correspond to those of a nonhuman immunoglobulin and all or substantially all of the FRs are those of a human immunoglobulin sequence. In certain embodiments, the humanized antibody will comprise at least a portion of an immunoglobulin constant region (Fc), typically that of a human immunoglobulin. For further details, see, Jones et al., *Nature*, 321:522-525 (1986); Riechmann et al., *Nature*, 332:323-329 (1988); and Presta, *Curr. Op. Struct. Biol.*, 2:593-596 (1992); Carter et al., *Proc. Natl. Acd. Sci. USA* 89:4285-4289 (1992); and U.S. Pat. No. 6,800,738 (issued Oct. 5, 2004), U.S. Pat. No. 6,719,971 (issued Sep. 27, 2005), U.S. Pat. No. 6,639,055 (issued Oct. 28, 2003), U.S. Pat. No. 6,407,213 (issued Jun. 18, 2002), and U.S. Pat. No. 6,054,297 (issued Apr. 25, 2000).

An antibody that "inhibits the growth of and/or kills cells expressing C10orf54" or a "growth inhibitory" or "cytotoxic" antibody is one which results in measurable growth inhibition and/or killing of cells expressing or overexpressing the appropriate C10orf54 polypeptide. In some embodiments, such antibodies can inhibit the growth of and/or kill cells expressing C10orf54. Such cells include regulatory T cells (e.g., a CD4+ Foxp3+ regulatory T cells), a myeloid-derived suppressor cells (e.g.,a CD11b+ or CD11bhigh myeloid-derived suppressor cells) and/or a suppressive dendritic cells (e.g., a CD11b+ or CD11bhigh dendritic cells). In a specific embodiment, antibodies inhibit the growth of and/or kill a cancer cell, a pre-cancerous cell, or a cell comprising a tumor. Certain growth inhibitory anti-C10orf54 antibodies inhibit growth of and/or kill C10orf54-expressing cells by greater than 20%, such as from about 20% to about 50%, or by greater than 50% (e.g., from about 50% to about 100%) as compared to the appropriate control, the control typically being cells not treated with the antibody being tested. In one embodiment, growth inhibition and/or killing can be measured at an antibody concentration of about 0.1 to 30 g/ml or about 0.5 nM to 200 nM in cell culture, where the growth inhibition is determined 1-10 days after exposure of the tumor cells to the antibody. Growth inhibition and/or killing of cells in vivo can be determined in various ways such as is described below. In the context of inhibiting a cancer cell or a cell comprising a tumor, the antibody is growth inhibitory or kills in vivo if administration of the anti-C10orf54 antibody at about 1 g/kg to about 100 mg/kg body weight results in reduction in tumor size or tumor cell proliferation within about 5 days to 3 months from the first administration of the antibody, such as within about 5 to 30 days.

As used herein, the term "in combination" in the context of the administration of other therapies refers to the use of more than one therapy. The use of the term "in combination" does not restrict the order in which therapies are administered to a subject with an infection. A first therapy can be administered before (e.g., 1 minute, 45 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks), concurrently, or after (e.g., 1 minute, 45 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks) the administration of a second therapy to a subject which had, has, or is susceptible to a C10orf54-mediated disease. Any additional therapy can be administered in any order with the other additional therapies. In certain embodiments, the antibodies can be administered in combination with one or more therapies (e.g., therapies that are not the antibodies that are currently administered to prevent, treat, manage, and/or ameliorate a C10orf54-mediated disease. Non-limiting examples of therapies that can be administered in combination with an antibody include analgesic agents, anesthetic agents, antibiotics, or immunomodulatory agents or any other agent listed in the U.S. Pharmacopoeia and/or Physician's Desk Reference.

An antibody that "induces cell death" is one that causes a viable cell to become nonviable. The cell is of a cell type that specifically expresses or overexpresses a C10orf54 polypeptide. The cell may be cancerous or a normal cell of the particular cell type, such as a regulatory T cell. Cell death in vitro may be determined in the absence of complement and immune effector cells to distinguish cell death induced by antibody-dependent cell-mediated cytotoxicity (ADCC) or complement dependent cytotoxicity (CDC). Thus, the assay for cell death may be performed using heat inactivated serum (e.g., in the absence of complement) and in the absence of immune effector cells. To determine whether the antibody is able to induce cell death, loss of membrane integrity as evaluated by uptake of propidium iodide (PI), trypan blue (see Moore et al. *Cytotechnology* 17:1-11 (1995)). In some embodiments, cell death-inducing antibodies are those which induce PI uptake in the PI uptake assay in C10orf54 expressing cells.

An "isolated" antibody is substantially free of cellular material or other contaminating proteins from the cell or tissue source and/or other contaminant components from which the antibody is derived, or substantially free of chemical precursors or other chemicals when chemically synthesized. The language "substantially free of cellular material" includes preparations of an antibody in which the antibody is separated from cellular components of the cells from which it is isolated or recombinantly produced. Thus, an antibody that is substantially free of cellular material includes preparations of antibody having less than about 30%, 20%, 10%, or 5% (by dry weight) of heterologous protein (also referred to herein as a "contaminating protein"). In certain embodiments, when the antibody is recombinantly produced, it is substantially free of culture medium, e.g., culture medium represents less than about 20%, 10%, or 5% of the volume of the protein preparation. In certain embodiments, when the antibody is produced by chemical synthesis, it is substantially free of chemical precursors or other chemicals, e.g., it is separated from chemical precursors or other chemicals which are involved in the synthesis of the protein. Accordingly such preparations of the antibody have less than about 30%, 20%, 10%, 5% (by dry weight) of chemical precursors or compounds other than the antibody of interest. Contaminant components can also include, but are not limited to, materials that would interfere with therapeutic uses for the antibody, and may include enzymes, hormones, and other proteinaceous or nonproteinaceous solutes. In certain embodiments, the antibody will be purified (1) to greater than 95% by weight of antibody as determined by the Lowry method (Lowry et al. J. Bio. Chem. 193: 265-275, 1951), such as 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step. In a specific embodiment, antibodies provided herein are isolated or purified.

An "isolated" nucleic acid molecule is one which is separated from other nucleic acid molecules which are present in the natural source of the nucleic acid molecule. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. In a specific embodiment, a nucleic acid molecule(s) encoding an antibody provided herein is isolated or purified.

The term "leaving group," as used herein, refers to any group that leaves in the course of a chemical reaction involving the group as described herein and includes but is not limited to halogen, sulfonates (brosylate, mesylate, tosylate triflate etc . . . ), p-nitrobenzoate and phosphonate groups, for example.

The term "light chain" when used in reference to an antibody refers to a polypeptide chain of about 25 kDa, wherein the amino-terminal portion includes a variable region of about 100 to about 110 or more amino acids and a carboxy-terminal portion that includes a constant region. The approximate length of a light chain is 211 to 217 amino acids. There are two distinct types, referred to as kappa (κ) of lambda (λ) based on the amino acid sequence of the constant domains. Light chain amino acid sequences are well known in the art. A light chain can be a human light chain.

A "linker" (noted as L or $L^1$, $L^2$ and $L^3$) is a molecule with two reactive termini, one for conjugation to an antibody or to another linker and the other for conjugation to a cytotoxin. The antibody conjugation reactive terminus of the linker is typically a site that is capable of conjugation to the antibody through a cysteine thiol or lysine amine group on the antibody, and so is typically a thiol-reactive group such as a double bond (as in maleimide) or a leaving group such as a chloro, bromo or iodo or an R-sulfanyl group or sulfonyl group, or an amine-reactive group such as a carboxyl group or as defined herein; while the antibody conjugation reactive terminus of the linker is typically a site that is capable of conjugation to the cytotoxin through formation of an amide bond with a basic amine or carboxyl group on the cytotoxin, and so is typically a carboxyl or basic amine group. In one embodiment, when the term "linker" is used in describing the linker in conjugated form, one or both of the reactive termini will be absent (such as the leaving group of the thiol-reactive group) or incomplete (such as the being only the carbonyl of the carboxylic acid) because of the formation of the bonds between the linker and/or the cytotoxin. The linkers disclosed herein may be cleavable under normal physiological and/or intracellular conditions, or may remain stable (e.g., uncleaved or non-cleavable) under those same conditions. Examples of cleavable linkers are linkers which contain dipeptide moieties, where the peptide bond connecting the two peptides has the potential to be selectively cleaved by lysosomal proteases (e.g., cathepsin-B). Valine-citruline (Val-Cit) is a dipeptide moiety commonly used in cleavable linkers.

As used herein, the terms "manage," "managing," and "management" refer to the beneficial effects that a subject derives from a therapy (e.g., a prophylactic or therapeutic agent), which does not result in a cure of the disease. In certain embodiments, a subject is administered one or more therapies (e.g., prophylactic or therapeutic agents, such as an antibody provided herein) to "manage" a C10orf54-mediated disease, one or more symptoms thereof, so as to prevent the progression or worsening of the disease.

The term "monoclonal antibody" refers to an antibody obtained from a population of homogenous or substantially homogeneous antibodies, and each monoclonal antibody will typically recognize a single epitope on the antigen. In specific embodiments, a "monoclonal antibody," as used herein, is an antibody produced by a single hybridoma or other cell, wherein the antibody binds to only a C10orf54 epitope as determined, e.g., by ELISA or other antigen-binding or competitive binding assay known in the art. The term "monoclonal" is not limited to any particular method for making the antibody. For example, monoclonal antibodies provided herein may be made by the hybridoma method as described in Kohler et al.; Nature, 256:495 (1975) or may be isolated from phage libraries using the techniques. Other methods for the preparation of clonal cell lines and of monoclonal antibodies expressed thereby are well known in the art (see, for example, Chapter 11 in: *Short Protocols in Molecular Biology*, (2002) 5th Ed., Ausubel et al., eds., John Wiley and Sons, New York). Other exemplary methods of producing other monoclonal antibodies are provided in the Examples herein.

The term "native" when used in connection with biological materials such as nucleic acid molecules, polypeptides, host cells, and the like, refers to those which are found in nature and not manipulated by a human being.

The term "pharmaceutically acceptable" as used herein means being approved by a regulatory agency of the Federal or a state government, or listed in the U.S. Pharmacopeia, European Pharmacopeia or other generally recognized Pharmacopeia for use in animals, and more particularly in humans.

"Polyclonal antibodies" as used herein refers to an antibody population generated in an immunogenic response to a protein having many epitopes and thus includes a variety of different antibodies directed to the same and to different epitopes within the protein. Methods for producing polyclonal antibodies are known in the art (See, e.g., see, for example, Chapter 11 in: *Short Protocols in Molecular Biology*, (2002) 5th Ed., Ausubel et al., eds., John Wiley and Sons, New York).

As used herein, the term "polynucleotide," "nucleotide," nucleic acid" "nucleic acid molecule" and other similar terms are used interchangeable and include DNA, RNA, mRNA and the like.

A "pre-cancerous cell" refers to a cell that has an abnormal appearance such as a difference in size or shape in comparison to cells of the surrounding tissue or normal cells of its cell type, but are not invasive. The appearance of pre-cancerous cells can be suggestive of an increased cancer risk. Pre-cancerous cells expressing C10orf54 can be identified using methods disclosed herein, which can include analyzing a sample of cells from a patient.

As used herein, the terms "prevent," "preventing," and "prevention" refer to the total or partial inhibition of the development, recurrence, onset or spread of a C10orf54-mediated disease and/or symptom related thereto, resulting from the administration of a therapy or combination of therapies provided herein (e.g., a combination of prophylactic or therapeutic agents, such as an antibody provided herein).

As used herein, the term "prophylactic agent" refers to any agent that can totally or partially inhibit the development, recurrence, onset or spread of a C10orf54-mediated disease and/or symptom related thereto in a subject. In certain embodiments, the term "prophylactic agent" refers to an anti-C10orf54 antibody provided herein. In certain other embodiments, the term "prophylactic agent" refers to an agent other than an anti-C10orf54 antibody provided herein. In certain embodiments, a prophylactic agent is an agent which is known to be useful to or has been or is currently being used to prevent a C10orf54-mediated disease and/or a symptom related thereto or impede the onset, development, progression and/or severity of a C10orf54-mediated disease and/or a symptom related thereto. In specific embodiments, the prophylactic agent is a humanized anti-C10orf54 antibody, such as a humanized anti-C10orf54 monoclonal antibody.

In certain embodiments, a "prophylactically effective serum titer" is the serum titer in a subject, preferably a human, that totally or partially inhibits the development, recurrence, onset or spread of a C10orf54-mediated disease and/or symptom related thereto in the subject.

The term "recombinant antibody" refers to an antibody that is prepared, expressed, created or isolated by recombinant means. Recombinant antibodies can be antibodies expressed using a recombinant expression vector transfected into a host cell, antibodies isolated from a recombinant, combinatorial antibody library, antibodies isolated from an animal (e.g., a mouse or cow) that is transgenic and/or transchromosomal for human immunoglobulin genes (see e.g., Taylor, L. D. et al. (1992) *Nucl. Acids Res.* 20:6287-6295) or antibodies prepared, expressed, created or isolated by any other means that involves splicing of immunoglobulin gene sequences to other DNA sequences. Such recombinant antibodies can have variable and constant regions derived from human germ line immunoglobulin sequences (See Kabat, E. A. et al. (1991) *Sequences of Proteins of Immunological Interest*, Fifth Edition, U.S. Department of Health and Human Services, NIH Publication No. 91-3242). In certain embodiments, however, such recombinant antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germ line repertoire in vivo.

The term "serum titer" as used herein refers to an average serum titer in a population of least 10, such as at least 20, or at least 40 subjects, up to about 100, 1000 or more.

As used herein, the term "side effects" encompasses unwanted and adverse effects of a therapy (e.g., a prophylactic or therapeutic agent). Unwanted effects are not necessarily adverse. An adverse effect from a therapy (e.g., a prophylactic or therapeutic agent) might be harmful or uncomfortable or risky. Examples of side effects include, diarrhea, cough, gastroenteritis, wheezing, nausea, vomiting, anorexia, abdominal cramping, fever, pain, loss of body weight, dehydration, alopecia, dyspenea, insomnia, dizziness, mucositis, nerve and muscle effects, fatigue, dry mouth, and loss of appetite, rashes or swellings at the site of administration, flu-like symptoms such as fever, chills and fatigue, digestive tract problems and allergic reactions. Additional undesired effects experienced by patients are numerous and known in the art. Many are described in the *Physician's Desk Reference* (67$^{th}$ ed., 2013).

As used herein, the terms "subject" and "patient" are used interchangeably. As used herein, in certain embodiments, a subject is a mammal, such as a non-primate (e.g., cows, pigs, horses, cats, dogs, rats, etc.) or a primate (e.g., monkey and human). In specific embodiments, the subject is a human. In one embodiment, the subject is a mammal (e.g., a human) having a C10orf54-mediated disease. In another embodiment, the subject is a mammal (e.g., a human) at risk of developing a C10orf54-mediated disease.

As used herein "substantially all" refers to refers to at least about 60%, at least about 70%, at least about 75%, at least about 80%, at least about 85%, at least about 90%, at least about 95%, at least about 98%, at least about 99%, or about 100%.

As used herein, the term "therapeutic agent" refers to any agent that can be used in treating, preventing or alleviating a disease, disorder or condition, including in the treatment, prevention or alleviation of one or more symptoms of a C10orf54-mediated disease, disorder, or condition and/or a symptom related thereto. In certain embodiments, a therapeutic agent refers to an antibody provided herein. In certain other embodiments, a therapeutic agent refers to an agent other than an antibody provided herein. In certain embodiments, a therapeutic agent is an agent which is known to be useful for, or has been or is currently being used for the treatment, prevention or alleviation of one or more symptoms of a C10orf54-mediated disease, disorder, condition, or a symptom related thereto.

The combination of therapies (e.g., use of therapeutic agents) can be more effective than the additive effects of any two or more single therapy. For example, a synergistic effect of a combination of therapeutic agents permits the use of lower dosages of one or more of the agents and/or less frequent administration of the agents to a subject with a C10orf54-mediated disease. The ability to utilize lower dosages of therapeutic therapies and/or to administer the therapies less frequently reduces the toxicity associated with the administration of the therapies to a subject without reducing the efficacy of the therapies in the prevention, treatment or alleviation of one or more symptom of a C10orf54-mediated disease. In addition, a synergistic effect can result in improved efficacy of therapies in the prevention, treatment or alleviation of one or more symptom of a C10orf54-mediated disease. Finally, synergistic effect of a combination of therapies (e.g., therapeutic agents) may avoid or reduce adverse or unwanted side effects associated with the use of any single therapy.

The term "therapeutically effective amount" as used herein refers to the amount of a therapeutic agent (e.g., an antibody provided herein or any other therapeutic agent provided herein) that is sufficient to reduce and/or ameliorate the severity and/or duration of a given disease and/or a symptom related thereto. A therapeutically effective amount of a therapeutic agent can be an amount necessary for the reduction or amelioration of the advancement or progression of a given disease, reduction or amelioration of the recurrence, development or onset of a given disease, and/or to improve or enhance the prophylactic or therapeutic effect of another therapy (e.g., a therapy other than the administration of an antibody provided herein).

In certain embodiments, a "therapeutically effective serum titer" is the serum titer in a subject, preferably a human, that reduces the severity, the duration and/or the symptoms associated with a C10orf54-mediated disease in the subject.

As used herein, the term "therapy" refers to any protocol, method and/or agent that can be used in the prevention, management, treatment and/or amelioration of a C10orf54-mediated disease. In certain embodiments, the terms "therapies" and "therapy" refer to a biological therapy, supportive therapy, and/or other therapies useful in the prevention, management, treatment and/or amelioration of a C10orf54-mediated disease known to one of skill in the art such as medical personnel.

The term "thiol," as used herein, refers to the radical —SH.

As used herein, the terms "treat," "treatment" and "treating" refer to the reduction or amelioration of the progression, severity, and/or duration of a C10orf54-mediated disease resulting from the administration of one or more therapies (including, but not limited to, the administration of one or more therapeutic agents, such as an antibody provided herein). In specific embodiments, such terms refer to the reduction or inhibition of cancer or tumor formation. In other specific embodiments, such term refers to the reduction or amelioration of the progression, severity and/or duration of graft-versus-host disease. In yet other specific embodiments, such terms refer to the reduction or amelioration of the progression, severity, and/or duration of a disease that is responsive to immune modulation, such modulation resulting from increasing T cell activation, increasing T cell proliferation or increasing cytokine production.

"Tubulysin" includes both the natural products described as tubulysins, such as by Sasse et al. and other authors mentioned in the Description of the related art, and also the tubulysin analogs described in US Patent Application Publication No. US 2011/0021568 A1. Tubulysins disclosed in the present application are noted herein and may include the tubulysins of the formulae T3 and T4, and other tubulysins where the terminal N-methylpiperidine has been replaced by an unsubstituted piperidine, allowing amide bond formation with a linker.

The term "variable domain" or "variable region" refers to a portion of the light or heavy chains of an antibody that is generally located at the amino-terminal of the light or heavy chain and has a length of about 120 to 130 amino acids in the heavy chain and about 100 to 110 amino acids in the light chain, and are used in the binding and specificity of each particular antibody for its particular antigen. The variable domains differ extensively in sequence between different antibodies. The variability in sequence is concentrated in the CDRs while the less variable portions in the variable domain are referred to as framework regions (FR). The CDRs of the light and heavy chains are primarily responsible for the interaction of the antibody with antigen. In specific embodiments, the variable region is a human variable region.

The term "variable domain residue numbering as in Kabat" or "amino acid position numbering as in Kabat", and variations thereof, refers to the numbering system used for heavy chain variable domains or light chain variable domains of the compilation of antibodies in Kabat et al., *Sequences of Proteins of Immunological Interest*, 5th Ed. Public Health Service, National Institutes of Health, Bethesda, Md. (1991). Using this numbering system, the actual linear amino acid sequence may contain fewer or additional amino acids corresponding to a shortening of, or insertion into, a FR or CDR of the variable domain. For example, a heavy chain variable domain may include a single amino acid insert (residue 52a according to Kabat) after residue 52 of H2 and inserted residues (e.g. residues 82a, 82b, and 82c, etc, according to Kabat) after heavy chain FR residue 82. The Kabat numbering of residues may be determined for a given antibody by alignment at regions of homology of the sequence of the antibody with a "standard" Kabat numbered sequence. The Kabat numbering system is generally used when referring to a residue in the variable domain (approximately residues 1-107 of the light chain and residues 1-113 of the heavy chain) (e.g, Kabat et al., *Sequences of Immunological Interest*. 5th Ed. Public Health Service, National Institutes of Health, Bethesda, Md. (1991)). The "EU numbering system" or "EU index" is generally used when referring to a residue in an immunoglobulin heavy chain constant region (e.g., the EU index reported in Kabat et al., supra). The "EU index as in Kabat" refers to the residue numbering of the human IgG 1 EU antibody. Unless stated otherwise herein, references to residue numbers in the variable domain of antibodies means residue numbering by the Kabat numbering system. Other numbering systems have been described, including, for example, by AbM, Chothia, Contact and IMGT. Various numbering systems are illustrated in FIGS. 16A and 16B.

The term "variant" when used in relation to C10orf54 or to an anti-C10orf54 antibody refers to a peptide or polypeptide comprising one or more (such as, for example, about 1 to about 25, about 1 to about 20, about 1 to about 15, about 1 to about 10, or about 1 to about 5) amino acid sequence substitutions, deletions, and/or additions as compared to a native or unmodified sequence. For example, a C10orf54 variant may result from one or more (such as, for example, about 1 to about 25, about 1 to about 20, about 1 to about 15, about 1 to about 10, or about 1 to about 5) changes to an amino acid sequence of native C10orf54. Also by way of example, a variant of an anti-C10orf54 antibody may result from one or more (such as, for example, about 1 to about 25, about 1 to about 20, about 1 to about 15, about 1 to about 10, or about 1 to about 5) changes to an amino acid sequence of a native or previously unmodified anti-C10orf54 antibody. Variants may be naturally occurring, such as allelic or splice variants, or may be artificially constructed. Polypeptide variants may be prepared from the corresponding nucleic acid molecules encoding the variants. In specific embodiments, the C10orf54 variant or anti-C10orf54 antibody variant at least retains C10orf54 or anti-C10orf54 antibody functional activity, respectively. In specific embodiments, an anti-C10orf54 antibody variant binds C10orf54 and/or is antagonistic to C10orf54 activity. In specific embodiments, an anti-C10orf54 antibody variant binds C10orf54 and/or is agonistic to C10orf54 activity. In certain embodiments, the variant is encoded by a single nucleotide polymorphism (SNP) variant of a nucleic acid molecule that encodes C10orf54 or anti-C10orf54 antibody VH or VL regions or subregions.

The term "vector" refers to a substance that is used to introduce a nucleic acid molecule into a host cell. Vectors applicable for use include, for example, expression vectors, plasmids, phage vectors, viral vectors, episomes and artificial chromosomes, which can include selection sequences or markers operable for stable integration into a host cell's chromosome. Additionally, the vectors can include one or more selectable marker genes and appropriate expression control sequences. Selectable marker genes that can be included, for example, provide resistance to antibiotics or toxins, complement auxotrophic deficiencies, or supply critical nutrients not in the culture media. Expression control sequences can include constitutive and inducible promoters, transcription enhancers, transcription terminators, and the like which are well known in the art. When two or more nucleic acid molecules are to be co-expressed (e.g. both an antibody heavy and light chain), both nucleic acid molecules can be inserted, for example, into a single expression vector or in separate expression vectors. For single vector expression, the encoding nucleic acids can be operationally linked to one common expression control sequence or linked to different expression control sequences, such as one inducible promoter and one constitutive promoter. The introduction of nucleic acid molecules into a host cell can be confirmed using methods well known in the art. Such methods include, for example, nucleic acid analysis such as Northern blots or polymerase chain reaction (PCR) amplification of mRNA, or immunoblotting for expression of gene products, or other suitable analytical methods to test the expression of an introduced nucleic acid sequence or its corresponding gene product. It is understood by those skilled in the art that the nucleic acid molecule is expressed in a sufficient amount to produce the desired product (e.g. an anti-C10orf54 antibody provided herein), and it is further understood that expression levels can be optimized to obtain sufficient expression using methods well known in the art.

BRIEF DESCRIPTION OF THE DRAWINGS

FIG. 2 shows FACS analysis of 23 primary AML-BM-MNC and 3 normal BM-MNC samples using anti-C10orf54 antibody 76E1.

FIGS. 3A and 3B show humanized sequences for murine monoclonal antibody 76E1 VH region. SEQ ID NOS: 1, 7, 8, 12-15 and 82 are depicted.

FIGS. 4A and 4B show humanized sequences for murine monoclonal antibody 141A VH region. SEQ ID NOS: 2, 7, 8, 16-19 and 82 are depicted.

FIGS. 5A and 5B show humanized sequences for murine monoclonal antibody 175A VH region. SEQ ID NOS: 3, 7, 8, 20-23 and 82 are depicted.

FIGS. 6A and 6B show humanized sequences for murine monoclonal antibody 76E1 VL region. SEQ ID NOS: 4, 9, 10, 24, 25 and 94 are depicted.

FIGS. 7A and 7B show humanized sequences for murine monoclonal antibody 141A VL region. SEQ ID NOS: 5, 10, 11, 26, 27 and 94 are depicted.

FIGS. 8A and 8B show humanized sequences for murine monoclonal antibody 175A VL region. SEQ ID NOS: 6, 9, 10, 28, 29 and 94 are depicted.

FIG. 9 shows pseudo-sequences of VH and VL domains of murine monoclonal antibodies 76E1, 141A and 175A (SEQ ID NOS: 1143-1148). CDRs are identified in bold.

FIGS. 16A and 16B shows a sequence alignment of the variable heavy chains and variable light chains of the anti-C10orf54 murine antibodies designated 76E1, 141A and 175A (SEQ ID NOS:1-6). Boundaries of CDR's are indicated by Kabat, AbM, Chothia, Contact and IMGT numbering. R13 VH and R13 VL sequences disclosed as SEQ ID NOS 1934-1936 and 1937-1939, respectively, in order of appearance.

FIGS. 17A and 17B shows a sequence alignment of the variable heavy chains and variable light chains of exemplary humanized anti-C10orf54 antibodies designated hu76E1, hu141A and hu175A (SEQ ID NOS: 1135-1137 for heavy chains; SEQ ID NOS: 1139-1141 for light chains) and the corresponding consensus sequences between hu76E1 and hu175A (SEQ ID NO: 1138 for the heavy chain; SEQ ID NO: 1142 for the light chain). Residues indicated just below that alignment indicate specific residues that can be varied at the above "X" position in the consensus sequence.

FIG. 18A to 18D show alignments of antibody VH and VL sequences disclosed herein by paratope group. SEQ ID NOS: 1271-1280 for VH and VL are depicted. SEQ ID NOS: 1291, 1306, 1441, 1918, 1440, 1388, 1442, 1919, 1385, 1405, 1449, 1920, 1443, 1458, 1446, 1921, 1473, 1445, 1447, 1922, 1444, 1508, 1448 and 1923 for consensus CDR sequences within paratope groups are also depicted.

FIG. 19 shows exemplary human germline sequences for humanization of anti-C10orf54 antibodies described herein.

FIGS. 20A and 20B show selected human VH and human VL sequences for humanization of anti-C10orf54 antibodies described herein. SEQ ID NOS: 7, 1902-1904, 1907, 1905, 1906, 1912, 1910, 1908, 1909, 1913 (in order from top to bottom) for VH and VL sequences are depicted.

FIGS. 22A and 22B show humanized sequences for murine monoclonal antibody 26A VH and VL regions, respectively. SEQ ID NOS: 1902, 82, 1266, and 1529-1531 are depicted in FIG. 22A and SEQ ID NOS: 1910, 94, and 1532-1534 are depicted in FIG. 22B. Humanized VH designated h26AH1 and humanized VL designated h26AL1 are each "CDR-swap" constructs with no changes in the human framework. Subsequent sequences have altered amino acid residues. # indicates deamidation substitution: Q/S/A/D.

FIGS. 23A and 23B show humanized sequences for murine monoclonal antibody 128A VH and VL regions, respectively. SEQ ID NOS: 1902, 82, 1258, and 1535-1537 are depicted in FIG. 23A and SEQ ID NOS: 1907, 94, 1259, and 1538-1540 are depicted in FIG. 23B. Humanized VH designated h128AH1 and humanized VL designated h128AL1 are each "CDR-swap" constructs with no changes in the human framework. Subsequent sequences have altered amino acid residues. # indicates deamidation substitution: Q/S/A/D.

FIGS. 24A and 24B show humanized sequences for murine monoclonal antibody 124A VH and VL regions, respectively. SEQ ID NOS: 1902, 82, 1281, 1541, and 1542 are depicted in FIG. 24A and SEQ ID NOS: 1911, 94, 1282, 1546, and 1547 are depicted in FIG. 24B. Humanized VH designated h124AH1 and humanized VL designated h124AL1 are each "CDR-swap" constructs with no changes in the human framework. Subsequent sequences have altered amino acid residues. # indicates deamidation substitution: Q/S/A/D. @ indicates isoaspartate substitutions: Q/S/A.

FIGS. 25A and 25B show humanized sequences for murine monoclonal antibody 259A VH and VL regions, respectively. SEQ ID NOS: 1902, 82, 1275, and 1543-1545 are depicted in FIG. 25A and SEQ ID NOS: 1905, 94, 1276, 1548, and 1549 are depicted in FIG. 25B. Humanized VH designated h124AH1 and humanized VL designated h124AL1 are each "CDR-swap" constructs with no changes in the human framework. Subsequent sequences have altered amino acid residues. # indicates deamidation substitution: Q/S/A/D. @ indicates isoaspartate substitutions: E/S/A.

FIG. 26A shows the percentage of C10orf54 within Lin$^-$/CD11b$^+$ MDSC subpopulcations. FIG. 26B shows the copy number of C10orf54 for Lin$^-$/CD11b$^+$ MDSC subpopulations. MDSC populations are referred to as: monocytic (CD14+/HLA$^-$DR$^-$), granulocytic (CD15$^+$/HLA$^-$DR$^-$), and immature myeloid cells (CD15$^-$/HLA$^-$DR$^-$).

FIG. 30A shows pan T cells, 2 days upon stimulation. FIG. 30B shows naïve T cells, 2 days upon stimulation. FIG. 30C shows naïve T cells, 3 days upon stimulation.

DETAILED DESCRIPTION

Figure 1A:
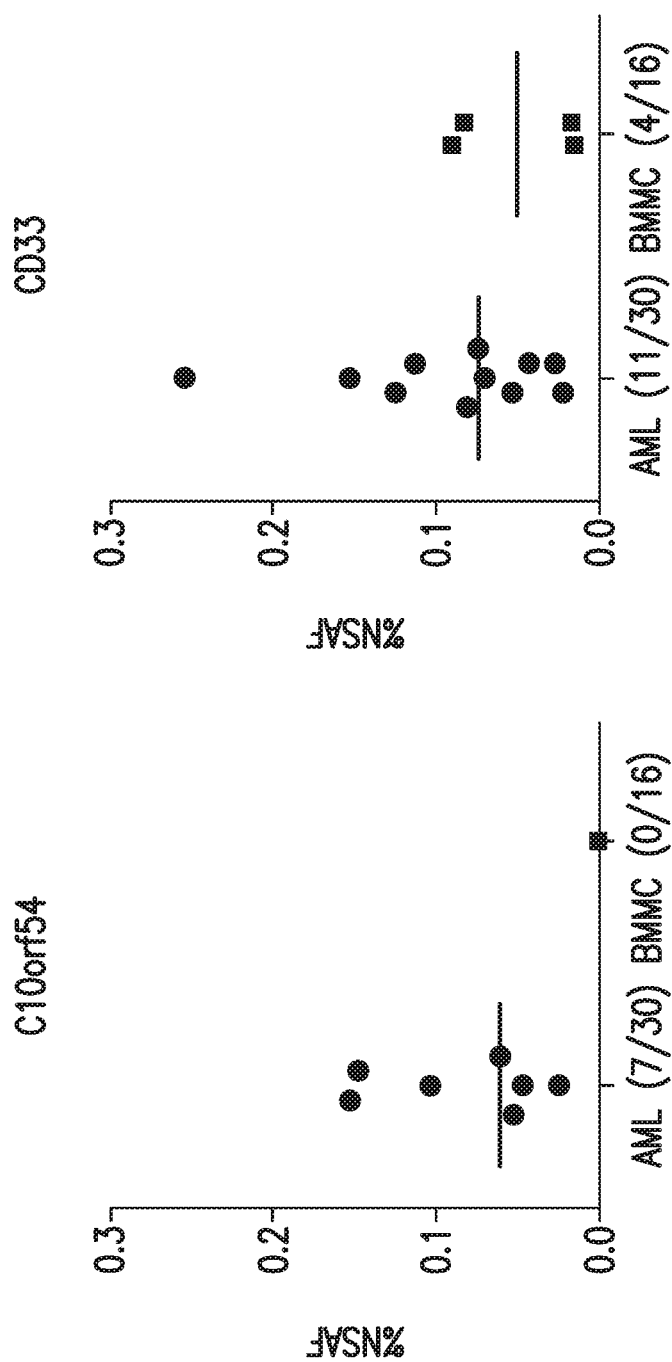
FIGS. 1A and 1B shows the protein expression level of C10orf54 that was identified and quantified by sTAg analysis in AML and BMMC samples and relevant control.

Provided herein are antibodies that bind to C10orf54, including a C10orf54 polypeptide, a C10orf54 polypeptide fragment, or a C10orf54 epitope. Such antibodies include humanized anti-C10orf54 antibodies. Also provided are antibodies (e.g., humanized anti-C10orf54 antibodies) that competitively block and anti-C10orf54 antibody provided herein from binding to a C10orf54 polypeptide. The anti-C10orf54 antibodies (e.g., humanized anti-C10orf54 antibodies) provided herein can also be conjugated or recombinantly fused to a diagnostic agent, detectable agent or therapeutic agent (e.g., antibody-drug conjugate). Further provided are compositions comprising an anti-C10orf54 antibody (e.g., a humanized anti-C10orf54 antibody). For example, a detectable agent may be a detectable probe.

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC10 (SEQ ID NO: 1251), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), and CC9 (SEQ ID NO: 1250).

In certain embodiments, the antibody provided herein binds a first group of C10orf54 proteins or chimeric proteins designated CC1 (SEQ ID NO: 1079), CC4 (SEQ ID NO: 1245), CC5 (SEQ ID NO: 1246), and CC8 (SEQ ID NO: 1249), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspected, such an antibody does not comprise one or more CDR sequences selected from the group consisting of 30, 1099, 1104, 1105, 1110, 31, 1100, 1106, 1111, 1116, 32, 1101, 1107, 1112, 45, 1102, 1108, 1113, 40, 1103, 1114, 41, 1109, and 1115.

In certain embodiments, the antibody provided herein binds to a first group of C10orf54 proteins or chimeric proteins designated CC1 (SEQ ID NO: 1079), CC4 (SEQ ID NO: 1245), and CC5 (SEQ ID NO: 1246), and does not bind to a second grouped of C10orf54 proteins or chimeric proteins designated (SEQ ID NO: 1243), CC3 (SEQ ID NO: 1244), CC6 (SEQ ID NO: 1247), CC7 (SEQ ID NO: 1248), CC8 (SEQ ID NO: 1249), CC9 (SEQ ID NO: 1250), and CC10 (SEQ ID NO: 1251). In some aspects, such an antibody does not comprise one or more CDR sequences selected from the group consisting of 36, 1081, 1086, 1087, 1092, 37, 1082, 1088, 1093, 1098, 38, 1083, 1089, 1094, 45, 1084, 1090, 1095, 46, 1085, 1096, 47, 1091, and 1097.

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC9 (SEQ ID NO: 1250), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspects, such an antibody does not comprise one or more CDR sequences selected from the group consisting of 33, 1117, 1122, 1123, 1128, 34, 1118, 1124, 1129, 1134, 35, 1119, 1125, 1130, 42, 1120, 1126, 1131, 43, 1121, 1132, 44, 1127, and 1133.

In certain embodiments, the antibody provided herein binds to a first group of C10orf54 proteins or chimeric proteins designated CC1 (SEQ ID NO: 1079), CC3 (SEQ ID NO: 1244), CC4 (SEQ ID NO: 1245), CC5 (SEQ ID NO: 1246), CC8 (SEQ ID NO: 1249), and CC9 (SEQ ID NO: 1250), and does not bind to a second grouped of C10orf54 proteins or chimeric proteins designated CC2 (SEQ ID NO: 1243), CC6 (SEQ ID NO: 1247), CC7 (SEQ ID NO: 1248), and CC10 (SEQ ID NO: 1251).

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC10 (SEQ ID NO: 1251), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251).

Also provided herein are isolated nucleic acid molecules encoding a VH chain, VL chain, VH domain, VL domain, VH CDR1, VH CDR2, VH CDR3, VL CDR1, VL CDR2, and/or VL CDR3 of anti-C10orf54 antibodies that bind to a C10orf54 polypeptide, a C10orf54 polypeptide fragment, or a C10orf54 epitope. Further provided are vectors and host cells comprising nucleic acid molecules encoding anti-C10orf54 antibodies that bind to a C10orf54 polypeptide, a C10orf54 polypeptide fragment, or a C10orf54 epitope. Also provided are methods of making antibodies that bind to a C10orf54 polypeptide, a C10orf54 polypeptide fragment, or a C10orf54 epitope.

Methods of using the anti-C10orf54 antibodies (e.g., humanized anti-C10orf54 antibodies) are provided. Methods include treating, preventing or alleviating a disease, disorder or condition, including one or more symptoms of a disease, disorder or condition, comprising administering a therapeutically effective amount of an anti-C10orf54 antibody, including an antibody-drug conjugate (ADC) comprising an anti-C10orf54 antibody, provided herein to a subject, thereby treating, preventing or alleviating the disease, disorder or condition, including one or more symptoms of the disease, disorder or condition. In some embodiments the anti-C10orf54 antibodies are humanized antibodies that bind to a C10orf54 polypeptide, a C10orf54 polypeptide fragment or a C10orf54 epitope. In one embodiment, the disease, disorder or condition is caused by or otherwise associated with C10orf54, including by or associated with C10orf54-expressing cells (e.g., tumor cells, myeloid-derived suppressor cells (MDSC), suppressive dendritic cells (suppressive DC), and/or regulatory T cells (T regs)). In certain embodiments, the disease is a cancer, such as a leukemia, bladder cancer, a skin cancer, a colon cancer, a breast cancer, a liver cancer, a kidney cancer, a lung cancer, a stomach cancer, a pancreas cancer, an esophagus cancer or a fibrosarcoma. In one embodiment, the leukemia is an acute myeloid leukemia (AML). In other embodiments, the disease is graft-versus-host disease (GVHD). Additional methods provided include using an anti-C10orf54 antibody with C10orf54 binding activity for C10orf54-expressing cells, provided herein, for example, as an unconjugated antibody or conjugated antibody (ADC), including to inhibit and/or kill the C10orf54-expressing cells (e.g., with anti-tumor activity to mediate an anti-tumor effect). In certain embodiments, the anti-C10orf54 antibodies, including ADCs comprising the anti-C10orf54 antibodies, provided herein inhibit C10orf54-mediated suppressor activity on T cells (e.g., to allow an effective anti-tumor immune response). In certain embodiments, the anti-C10orf54 antibodies provided herein directly kill C10orf54-expressing cells (e.g., C10orf54-bearing tumor cells, myeloid-derived suppressor cells (MDSC), suppressive dendritic cells (suppressive DC), and/or regulatory T cells (T regs)), for example, via antibody-dependent cellular cytotoxicity (ADCC) and/or complement-dependent cytotoxicity (CDC) In certain embodiments, antibody drug conjugates (ADCs) comprising anti-C10orf54 antibodies provided herein directly kill C10orf54-expressing cells including by binding to cells expressing C10orf54 (e.g., tumor cells, myeloid-derived suppressor cells (MDSC), suppressive dendritic cells (suppressive DC), and/or regulatory T cells (T regs)), for example, by allowing internalization of the cytotoxic drug. In any of the above embodiments, the anti-C10orf54 antibody can be a humanized anti-C10orf54 antibody provided herein that binds to a C10orf54 polypeptide, a C10orf54 polypeptide fragment or a C10orf54 epitope. In any of the above embodiments, the anti-C10orf54 antibody can be a humanized anti-C10orf54 antibody provided herein that binds to a C10orf54 polypeptide, a C10orf54 polypeptide fragment or a C10orf54 epitope.

Additional methods of using an anti-C10orf54 antibody are provided.

The methods include methods of inhibiting the growth of cells and/or killing cells having cell surface expression of C10orf54 comprising contacting the cells with an effective amount of an anti-C10orf54 antibody or antibody-drug conjugates provided herein. In one embodiment, the cell is a regulatory T cell (e.g., a CD4+ Foxp3+ regulatory T cell). In other embodiments, the cell is a myeloid-derived suppressor cell (e.g., a CD11b+ or CD11b$^{high}$ myeloid-derived suppressor cell) or a suppressive dendritic cell (e.g., a CD11b+ or CD11b$^{high}$ dendritic cell). In other embodiments, the cell is a cancerous or pre-cancerous cell. Additional methods provided include using an anti-C10orf54 antibody with C10orf54 binding activity for C10orf54-expressing cells provided herein, for example, as an unconjugated antibody or conjugated antibody (ADC) including to inhibit and/or kill C10orf54-expressing cells (e.g., with anti-tumor activity to mediate an anti-tumor effect). In certain embodiments, the anti-C10orf54 antibodies, including ADCs comprising the anti-C10orf54 antibodies, provided herein inhibit C10orf54-mediated suppressor activity on T cells (e.g., to allow an effective anti-tumor immune response). In certain embodiments, the anti-C10orf54 antibodies provided herein directly kill C10orf54-expressing cells (e.g., C10orf54-bearing tumor cells, myeloid-derived suppressor cells (MDSC), suppressive dendritic cells (suppressive DC), and/or regulatory T cells (T regs)), for example, via antibody-dependent cellular cytotoxicity (ADCC) and/or complement-dependent cytotoxicity (CDC) In certain embodiments, antibody drug conjugates (ADCs) comprising anti-C10orf54 antibodies provided herein directly kill C10orf54-expressing cells including by binding to cells expressing C10orf54 (e.g., tumor cells, myeloid-derived suppressor cells (MDSC), suppressive dendritic cells (suppressive DC), and/or regulatory T cells (T regs)), for example, by allowing internalization of the cytotoxic drug. In any of the above embodiments, the anti-C10orf54 antibody can be a humanized anti-C10orf54 antibody provided herein that binds to a C10orf54 polypeptide, a C10orf54 polypeptide fragment or a C10orf54 epitope.

The methods include methods of modulating an immune response in a subject comprising administering an effective amount of an anti-C10orf54 antibody (e.g., a humanized anti-C10orf54 antibody) provided herein to a subject. In one embodiment, the modulating comprises increasing T cell activation. In other embodiment, the modulating comprises increasing T cell proliferation. In another embodiment, the modulating comprises increasing cytokine production.

The methods include methods for detecting C10orf54 in a sample comprising contacting the sample with an anti-C10orf54 antibody (e.g., a humanized anti-C10orf54 antibody) provided herein, such as an antibody that comprises a detectable agent. In certain embodiments, the sample comprises a cell expressing C10orf54 on its surface.

The methods include methods of treating cancers comprising administering to a subject an anti-C10orf54 antibody or an antibody-drug conjugate (ADC) comprising an anti-C10orf54 (e.g., an ADC of the formula A-L-CTX, wherein A is the antibody, L is a linker, and CTX is a cytotoxic agent) in a therapeutically effective amount, including in an amount effective to kill a C10orf54-expressing cell (e.g., tumor cell, myeloid-derived suppressor cell (MDSC), suppressive dendritic cell (suppressive DC), and/or regulatory T cell (T reg)). In some embodiments the cancer is acute myeloid leukemia (AML). In any of the above embodiments, the anti-C10orf54 antibody can be a humanized anti-C10orf54 antibody provided herein that binds to a C10orf54 polypeptide, a C10orf54 polypeptide fragment or a C10orf54 epitope.

The methods include methods of killing C10orf54-expressing cells (e.g., tumor cells, myeloid-derived suppressor cells (MDSC), suppressive dendritic cells (suppressive DC), and/or regulatory T cells (T reg)) comprising contacting a C10orf54-expressing cell (e.g., tumor cell, myeloid-derived suppressor cell (MDSC), suppressive dendritic cell (suppressive DC), and/or regulatory T cell (T regs)) with an amount of an anti-C10orf54 antibody or an antibody-drug conjugate (ADC) comprising an anti-C10orf54 antibody (e.g., an ADC of the formula A-L-CTX, wherein A is the antibody, L is a linker, and CTX is a cytotoxic agent) effective to kill the cell (e.g., tumor cell, myeloid-derived suppressor cell (MDSC), suppressive dendritic cell (suppressive DC), and/or regulatory T cell (T reg)). In some embodiments, the tumor cell is an AML cell. In any of the above embodiments, the anti-C10orf54 antibody can be a humanized anti-C10orf54 antibody provided herein that binds to a C10orf54 polypeptide, a C10orf54 polypeptide fragment or a C10orf54 epitope.

In one embodiment, provided herein is a kit comprising an anti-C10orf54 antibody (e.g., a humanized anti-C10orf54 antibody) that binds to a C10orf54 polypeptide, a C10orf54 polypeptide fragment, or a C10orf54 epitope provided herein. In some embodiments, the kits comprise an antibody-drug conjugate (ADC) wherein the antibody is an anti-C10orf54 antibody (e.g., a humanized anti-C10orf54 antibody).

Antibodies

In some embodiments, provided herein are antibodies that bind to C10orf54, including a C10orf54 polypeptide, a C10orf54 polypeptide fragment or a C10orf54 epitope. In some embodiments the anti-C10orf54 antibodies are humanized antibodies that bind C10orf54, including to a C10orf54 polypeptide, a C10orf54 polypeptide fragment or a C10orf54 epitope.

In certain embodiments, the anti-C10orf54 antibody comprises a VH domain, VL domain, VH CDR1, VH CDR2, VH CDR3, VL CDR1, VL CDR2, and/or VL CDR3 of the murine monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A as depicted in Table 2 and FIGS. 3-8, 22A, 22B, 23A, 23B, 24A, 24B, 25A, and 25B. Accordingly, in some aspects, the VH domain comprises the amino acid sequence of SEQ ID NO:1. In some embodiments, the VH domain comprises the amino acid sequence of SEQ ID NO:2. In some embodiments, the VH domain comprises the amino acid sequence of SEQ ID NO:3. In some embodiments, the VH domain comprises the amino acid sequence of SEQ ID NO:1252. In some embodiments, the VH domain comprises the amino acid sequence of SEQ ID NO:1254. In some embodiments, the VH domain comprises the amino acid sequence of SEQ ID NO:1256. In some embodiments, the VH domain comprises the amino acid sequence of SEQ ID NO:1258. In some embodiments, the VH domain comprises the amino acid sequence of SEQ ID NO:1260. In some embodiments, the VH domain comprises the amino acid sequence of SEQ ID NO:1262. In some embodiments, the VH domain comprises the amino acid sequence of SEQ ID NO:1266. In some embodiments, the VH domain comprises the amino acid sequence of SEQ ID NO:1268. In some embodiments, the VH domain comprises the amino acid sequence of SEQ ID NO:1271. In some embodiments, the VH domain comprises the amino acid sequence of SEQ ID NO:1273. In some embodiments, the VH domain comprises the amino acid sequence of SEQ ID NO:1375. In some embodiments, the VH domain comprises the amino acid sequence of SEQ ID NO:1277. In some embodiments, the VH domain comprises the amino acid sequence of SEQ ID NO:1279. In some embodiments, the VH domain comprises the amino acid sequence of SEQ ID NO:1281. In some embodiments, the VH domain comprises the amino acid sequence of SEQ ID NO:1283. In some embodiments, the VH domain comprises the amino acid sequence of SEQ ID NO:1285. In some embodiments, the VH domain comprises the amino acid sequence of SEQ ID NO:1287. In some embodiments, the VH domain comprises the amino acid sequence of SEQ ID NO:1289. In some embodiments, the VL domain comprises the amino acid sequence of SEQ ID NO:4. In some embodiments, the VL domain comprises the amino acid sequence of SEQ ID NO:5. In some embodiments, the VL domain comprises the amino acid sequence of SEQ ID NO:6. In some embodiments, the VL domain comprises the amino acid sequence of SEQ ID NO:1253. In some embodiments, the VL domain comprises the amino acid sequence of SEQ ID NO:1255. In some embodiments, the VL domain comprises the amino acid sequence of SEQ ID NO:1257. In some embodiments, the VL domain comprises the amino acid sequence of SEQ ID NO:1259. In some embodiments, the VL domain comprises the amino acid sequence of SEQ ID NO:1261. In some embodiments, the VL domain comprises the amino acid sequence of SEQ ID NO:1263. In some embodiments, the VL domain comprises the amino acid sequence of SEQ ID NO:1265. In some embodiments, the VL domain comprises the amino acid sequence of SEQ ID NO:1267. In some embodiments, the VL domain comprises the amino acid sequence of SEQ ID NO:1269. In some embodiments, the VL domain comprises the amino acid sequence of SEQ ID NO:1270. In some embodiments, the VL domain comprises the amino acid sequence of SEQ ID NO:1272. In some embodiments, the VL domain comprises the amino acid sequence of SEQ ID NO:1274. In some embodiments, the VL domain comprises the amino acid sequence of SEQ ID NO:1276. In some embodiments, the VL domain comprises the amino acid sequence of SEQ ID NO:1278. In some embodiments, the VL domain comprises the amino acid sequence of SEQ ID NO:1280. In some embodiments, the VL domain comprises the amino acid sequence of SEQ ID NO:1282. In some embodiments, the VL domain comprises the amino acid sequence of SEQ ID NO:1284. In some embodiments, the VL domain comprises the amino acid sequence of SEQ ID NO:1286. In some embodiments, the VL domain comprises the amino acid sequence of SEQ ID NO:1288. In some embodiments, the VL domain comprises the amino acid sequence of SEQ ID NO:1290.

TABLE 2

Murine Antibody Sequences

| Murine Antibody | VH Domain* | VL Domain* |
|---|---|---|
| 76E1 | EVQLLQSGPELEKPGASVKISCKAS GYSFTGYNMNWVKQSNGKSLEWIG NIDPYYDYTSYNLKFKDKATLTVDK SSSTAYMQLKSLTSEDSAVYYCATS TMITPFDYWGQGTTLTVSS (SEQ ID NO: 1) | DVLMTQTPLSLPVSLGDQASISCRSSQ SIVHSNGNTYLEWYLQKPGQSPKLLIY KVSNRFSGVPDRFSGSGSGTDFTLKIN RVEAEDLGVYYCFQGSHVPWTFGGGT KLEIK (SEQ ID NO: 4) |
| 141A | QVQLQQSGAELMKPGASVKISCKAT GYTFSRYWIEWVKQRPGHGLEWIG EILPGSGSTNYNEKFKGKATFTADT SSNTAYMQLSSLTSEDSAVYYCAGE EVYDGYPWFGYWGQGTLVTVSA (SEQ ID NO: 2) | QIVLSQSPAILSASPGEKVTMTCRASSS LSYMHWYQQKPGSSPKPWIYATSNLA SGVPARFSGSGSGTSYSLTISRVEAED AATYYCQQWSSNPYTFGGGTKLEIK (SEQ ID NO: 5) |
| 175A | QVQLQQSGAELMKPGASVKISCKAT GYTFSTHWIEWVKQRPGHGLEWIG EILPGSGSTSYNEKFKGKATFTADT SSNTAYMQLSSLTSEDSAVYYCAR WLLYYYAMDYWGQGTSVTVSS (SEQ ID NO: 3) | DVLMTQTPLSLPVSLGDQASISCRSSQ SIVHSNGNTYLEWYLQKPGQSPKLLIY KLSNRFSGVPDRFSGSGSGTDFTLKIS RVEAEDLGVYYCFQGSHFPYTFGGGT KLEIK (SEQ ID NO: 6) |
| 5B | QVQLQQSGAELVRPGVSVKISCKG SGYTFTDYGMHWVKQSHAKSLEWI GIIDTYYGDATYNQKFKGKATMTVD KSSSTAYMELARLTSEDSAIYYCAR RAGNAMDYWGQGTSVTVSS (SEQ ID NO: 1252) | NIVMTQTPKFLLVSAGDRVTITCKASQS VSNDVAWYQQKPGQSPKLLIYYASNR YTGVPDRFTGSGYGTDFTFTISTVQAE DLAVYFCQQDYSSPRTFGGGTKLEIK (SEQ ID NO: 1253) |
| 46A | QVQLQQAGGELVRPGVSVKISCKG SGYTFTDYGMHWVKQSHAKSLEWI GIINTYYGDATYNQKFKGKATMTVD KSSSTAYMELARLTSEDSAIYYCAR | SIVMTQTPKFLLVSAGDRVTITCKASQS VSNDVAWYQQKPGQSPKLLIYYASNR YTGVPDRFTGSGYGTDFTFTISTVQAE DLAVYFCQQDYGSPRTFGGGTKLEIK |

TABLE 2-continued

Murine Antibody Sequences

| Murine Antibody | VH Domain* | VL Domain* |
|---|---|---|
| | RAGTAMDYWGQGTSVTVSS (SEQ ID NO: 1254) | (SEQ ID NO: 1255) |
| 97A | QVQLQQSGAELVRPGVSVKISCKG SGYTFTDYGMHWVKQSHAKSLEWI GVIDTYYGDASNNQKFKGKATMTV DKSSSTAYMELARLTSEDSAIYYCA RRAGNAMDYWGQGTSVTVSS (SEQ ID NO: 1256) | SIVMTQTPKFLLVSAGDRVAITCKASQS VSNDVAWYQQKPGQSPKLLIYYASNR YTGVPDRFTGSGYGTDFTFTISTVQAE DLAVYFCQQDYGSPRTFGGGTKLEIK (SEQ ID NO: 1257) |
| 128A | QVQLQQSGAELVRPGVSVKISCKG SGYTFTDYGMHWVKQSHAKSLEWI GLIDTYYGDATYNHKFKGKATMTVD KSSRTAYMELARLTSEDSAIYYCAR RAGNAMDYWGQGTSVTASS (SEQ ID NO: 1258) | NIAMTQTPKFLLVSAGDRVTITCKASQS VSNDIAWYQQKPGQSPRLLIYYASNRY TGVPDRFTGSGYGTDFTFTISTVQAED LAVYFCQQDYSSPRTFGGGTKLEIK (SEQ ID NO: 1259) |
| 146C | QVQLQQSGAELVRPGVSVKISCKG SGYTFTDYGMHWVKQSHAKSLEWI GLIDTYYGDATYNHKFKGKATMTVD KSSRTAYMELARLTSEDSAIYYCAR RAGNAMDYWGQGTSVTASS (SEQ ID NO: 1260) | NIAMTQTPKFLLVSAGDRVTITCKASQS VSNDIAWYQQKPGQSPRLLIYYASNRY TGVPDRFTGSGYGTDFTFTISTVQAED LAVYFCQQDYSSPRTFGGGTKLEIK (SEQ ID NO: 1261) |
| 208A | QVQLQQSGAELVRPGVSVKISCKG SGYTFTDYGMHWVKQSHAKSLEWI GVIDTYYGDAGYNQKFKGKATMTV DKSSSTAYMELARLTSEDSAIYYCA RRAGNAMDYWGQGTSVTVSS (SEQ ID NO: 1262) | SIVMTQTPKFLLVSAGDRVTITDKASQS VSNDVAWYQQKPGQSPKLLIYYASNR YTGVPDRFTGSGYGTDFTFTISTVQAE DLAVYFCQQDYSSPRTFGGGTKLEIK (SEQ ID NO: 1263) |
| 215A | EVQLQQSGPELVKPGASMKISCKAS GFSFTGYTMNWVKQSHGKNLEWIG LISPYNGGTSYNQKFKGKATLTVDK SSSTAYMELLSLTSEDSAVYYCARR AYGYAMDYWGQGTSVTVSS (SEQ ID NO: 1264) | QIVLTQSPAIMSASPGEKVTMTCSASS SVSYMFWYQQKPGSSPRLLIYDTSNLA SGVPLRFSGSGSGTSYSLTISRMEAED AATYYCQQWSSYPFTFGSGTKLEIK (SEQ ID NO: 1265) |
| 26A | EVQLQQSGPELVKPGASMKISCKAS GFSFTGYTMNWVKQSHVKNLEWIG LISPYNGGTSYNQKFKGKATLTVDK SSSTAYMELLSLTSEDSAVYYCARR AYGYAMDYWGQGTSVTVSS (SEQ ID NO: 1266) | QIVLTQSPAIMSASPGEKVTMTCSASS SVSYMYWYQQKPGSSPRLLIYDTSNL ASGVPLRFSGSGSGTSYSLTISRMEAE DAATYYCQQWSSYPFTFGSGTKLEIK (SEQ ID NO: 1267) |
| 164A | EVQLQQSGPELEKPGASVKISCKAS GYSFTGYNMNWVKQSNGKSLEWIG NIDPYYGSASYNQKFKGKATLTVDK SSTTAYMQLKSLTSEDSAVYYCTRS NYGYYGYFDVWGAGTTVTVSS (SEQ ID NO: 1268) | NIMMTQSPSSLAVSAGEKVTMSCKSS QSVLYSSNQKNYLAWYQQKPGQSPK LLIYWASTRESGVPDRFTGSGSGTDFT LTISSVQAEDLAVYYCHQFLSSYTFGG GTKLEMK (SEQ ID NO: 1269) VL Sequence #2: ENVLTQSPAIMAASPGEKVTMTCSASS SVSSSNLHWYQQKSGTSTKFWIYRTS NLASEVPAPFSGSGSGTSYSLTISSVE AEDAATYYCQQWSGYPRTFGGGTKLE IK (SEQ ID NO: 1270) |
| 230A | EVQLQQSGPELEKPGASVKISCKAS GYSFTGSNMNWVKQNNGKSLEWIG NIDPYYGYTTYNQKFKGKATLTVDK SSSTAYMQLKSLTSEDSAVYYCARD YDYALGYFDVWGAGTTVTVSS (SEQ ID NO: 1271) | DVVMTQTPLSLPVSLGDQASISCRSSQ SLVHSNGNTYLHWYLQKPGQSPKLLIY KVSNRFSGVPDRFSGSGSGTDFTLKIS RVEAEDLGVYFCSQSTHVPYTFGGGT KLEIK (SEQ ID NO: 1272) |
| 53A | EVQLQQSGPELVKPGASVKMSCKA SGYTFTSYFMHWVKQKPGQGLEWI GYIYPYNDGTKYNEKFKGKATLTSD KSSSTAYMELSSLTSEDSAVYYCAR FDYDTLRYWGQGTTLTVSS (SEQ ID NO: 1273) | DVVLTQTPLSLPVNIGDQASISDKSTKS LLNSDGFTYLDWYLQKPGQSPQLLIYL VSNRFSGVPDRFSGSGSGTDFTLKISR VEAEDLGVYYCFQSNYFPWTFGGGTK LEIK (SEQ ID NO: 1274) |
| 259A | EVQLQQSGPELVKPGASVKMSCKA SGYTFTSYFMHWVKQKPGQGLEWI GYIYPYNDGTKYNEKFKGKATLTSD KSSSTAYMDLSSLTSEDSAVYYCAR | DVVLTQTPLSLPVNIGDQASISDKSTKS LLNSDGFTYLDWYLQKPGQSPQLLIYLI SNRFSGVPDRFSGSGSGTDFTLKISRV EAEDLGVYYCFQSNYFPWTFGGGTKL |

TABLE 2-continued

Murine Antibody Sequences

| Murine Antibody | VH Domain* | VL Domain* |
|---|---|---|
|  | FDYDTLRYWGQGTTLTVSS (SEQ ID NO: 1275) | EIK (SEQ ID NO: 1276) |
| 33A | QVQLQQSGAELMKPGASVKISCKATGYTFSSYWIEWVKQRPGHGLEWIGEILPGSGSTSYNEKFKGKATFTADTSSNTAYMQLSGLTSEDSAVYYCARWLLYYYAMVYWGQGTSVTVSS (SEQ ID NO: 1277) | DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK (SEQ ID NO: 1278) |
| 39A | QVQLQQSGAELMKPGASVKISCKATGYTFSSNWIEWVKQRPGHGLEWIGEILPGSGSTSYNEKFKGKATFTADTSSNTAYMQLSSLTSEDSAVYYCARWLLYYYAMDYWGQGTSVTVSS (SEQ ID NO: 1279) | DVLMTQTPLSLPVSLGDPASISCRSSQSIVHNNGNTYLEWYLQKPGQSPKLLIYKVSNRFSGVPDRFSGSGSGTDFTLKISRVEAEDLGVYYCFQGSHVPYTFGGGTKLEIK (SEQ ID NO: 1280) |
| 124A | QVQLQQSGAELMKPGASVKISCKATGYTFSSNWIEWVKQRPGHGLEWMGEILPGSGSTSYNEKFKGKATFTADTSSNTAYMQLSSLTSEDSAVYYCARWLLYYYAMDFWGQGTSVTVSS (SEQ ID NO: 1281) | DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPYTFGGGTKLEIK (SEQ ID NO: 1282) |
| 321D | QVQLQQSGAELMKPGAAVKISCKATGYTFSSHWIEWVKQRPGHGLEWIGEILPGSGSTDYNEKFKGKATFTADTSSNTAYMQLSSLTSEDSAVYYCARWLLYYYAMDYWGQGTSVTVSS (SEQ ID NO: 1283) | DVLMTQTPLSLPVSLGDQASISCRSSQSIVHSNGNTYLEWYLQKPGQSPKLLIYKVSNRFSGVPDRFSGSGSGTDFTLKITRVEAEDLGVYYCFQGSHVPFTFGGGTKLEIK (SEQ ID NO: 1284) |
| 51A | QVQLQQSGAELMKPGASVKISCKATGYTFSRYWIEWVKQRPGHGLEWIGEILPGSGSTNYNEKFKGKATFTADTSSNTAYMQLSSLTSEDSAVYYCASEEVYDGYPWFGYWGQGTLVTVSA (SEQ ID NO: 1285) | QIVLSQSPAILSASPGEKVTMTCRASSSLSYMHWYQQRPGSSPKPWIYATSNLASGVPARFSGSGSGTSYSLTISRVEAEDAATYYCQQWSSNPYTFGGGTKLEIK (SEQ ID NO: 1286) |
| 353A | EVKLLESGGGLVQPGGSLKLSCAASGFDFSRYWMNWVRQAPGKGLEWIGEINPDSSTINYTPSLKDKFIISRDNAKNTLYLQMSKVRYEDTALYYCARPGEIYYYGSYWFAYWGQGTLVTVSA (SEQ ID NO: 1287) | DIVLTQSPASLAVSLGQRATISCRASESVEYYGTSLMQWFQQKPGQPPKLLIYAASNVESRVPARFSGSGSGTDFSLNIHPVEEDDIAMYFCQQSRKDPWTFGGGTKLEIK (SEQ ID NO: 1288) |
| 305A | DVQLQESGPGLVKPSQSLSLTCSVTGYSITSGYYWNWIRQFPGNKLEWMGYISYDGSNNYNPSLKNRISITRDTSKNQFFLKLNSVTTEDTATYYCARRHDYLSFAYWGQGTLVIVSA (SEQ ID NO: 1289) | DIVLTQSPASLAVSLGQRATISCKASQSVDYDGDSYMNWYQQKPGQPPKLLIYAASNLESGIPARFSGSGSGTDFTLNIHPVEEEDAATYYCQQSDEDPYTFGGGTKLEIK (SEQ ID NO: 1290) |

*Bold amino acid residues represent CDR sequences (CDR1 - first bolded sequence; CDR2 - second bolded sequence; CDR3 - third bolded sequence)

In certain embodiments, the anti-C10orf54 antibody comprises a VH FR1, VH FR2, VH FR3, VH FR4, VL FR1, VL FR2, VL FR3, and/or VL FR4 of a human germline immunoglobulin amino acid sequence or a variant thereof. For example, in some embodiments, the anti-C10orf54 antibody comprises a VH FR1, VH FR2, VH FR3, and/or VH FR4 depicted in a human germline sequence identified in Table 3. Accordingly, in some embodiments, the anti-C10orf54 antibody comprises a VH FR1, VH FR2, VH FR3, and/or VH FR4 of the human germline IGHV1-18 (SEQ ID NO:7) and IGHJ4-01 (SEQ ID NO: 82). In some embodiments, the anti-C10orf54 antibody comprises a VH FR1, VH FR2, VH FR3, and/or VH FR4 of the human germline IGHV3-48 (SEQ ID NO:8) and IGHJ4-01 (SEQ ID NO: 82). In some embodiments, the anti-C10orf54 antibody comprises a VH FR1, VH FR2, VH FR3, and/or VH FR4 of the human germline IGHV1-46*01 (SEQ ID NO:1902) and IGHJ4-01 (SEQ ID NO: 82). In some embodiments, the anti-C10orf54 antibody comprises a VH FR1, VH FR2, VH FR3, and/or VH FR4 of the human germline IGHV3-74*01 (SEQ ID NO:1903) and IGHJ4-01 (SEQ ID NO: 82). In some embodiments, the anti-C10orf54 antibody comprises a VH FR1, VH FR2, VH FR3, and/or VH FR4 of the human germline IGHV4-61*01 (SEQ ID NO:1904) and IGHJ4-01 (SEQ ID NO: 82). In some embodiments, the anti-C10orf54 antibody comprises a VL FR1, VL FR2, VL FR3, and/or VL FR4 of the human germline IGKV2-28 (SEQ ID NO:9) and IGKJ2-1 (SEQ ID NO:94). In some embodiments, the anti-C10orf54 antibody comprises a VL FR1, VL FR2, VL FR3, and/or VL FR4 of the human germline IGKV1-39 (SEQ ID NO:10) and IGKJ2-1 (SEQ ID NO:94). In some embodiments, the anti-C10orf54 antibody comprises a VL FR1, VL FR2, VL FR3, and/or VL FR4 of the human germline IGKV3-20 (SEQ ID NO:10) and IGKJ2-1 (SEQ ID NO:94). In some embodiments, the anti-C10orf54 antibody comprises a VL FR1, VL FR2, VL FR3, and/or VL FR4 of the human germline IGHV1-46*01 (SEQ ID NO:1920) and IGKJ2-1 (SEQ ID NO:94). In some embodiments, the anti-C10orf54 antibody comprises a VL FR1, VL FR2, VL FR3, and/or VL FR4 of the human germline IGHV3-74*01 (SEQ ID NO:1903) and IGKJ2-1 (SEQ ID NO:94). In some embodiments, the anti-C10orf54 antibody comprises a VL FR1, VL FR2, VL FR3, and/or VL FR4 of the human germline IGHV4-61*01 (SEQ ID NO:1904) and IGKJ2-1 (SEQ ID NO:94). In some embodiments, the anti-C10orf54 antibody comprises a VL FR1, VL FR2, VL FR3, and/or VL FR4 of the human germline IGKV2-28*01 (SEQ ID NO:1905) and IGKJ2-1 (SEQ ID NO:94). In some embodiments, the anti-C10orf54 antibody comprises a VL FR1, VL FR2, VL FR3, and/or VL FR4 of the human germline IGKV2-29*02 (SEQ ID NO:1906) and IGKJ2-1 (SEQ ID NO:94). In some embodiments, the anti-C10orf54 antibody comprises a VL FR1, VL FR2, VL FR3, and/or VL FR4 of the human germline IGKV1-39*01 (SEQ ID NO:1907) and IGKJ2-1 (SEQ ID NO:94). In some embodiments, the anti-C10orf54 antibody comprises a VL FR1, VL FR2, VL FR3, and/or VL FR4 of the human germline IGKV3-20*01 (SEQ ID NO:1908) and IGKJ2-1 (SEQ ID NO:94). In some embodiments, the anti-C10orf54 antibody comprises a VL FR1, VL FR2, VL FR3, and/or VL FR4 of the human germline IGKV3D-20*01 (SEQ ID NO:1909) and IGKJ2-1 (SEQ ID NO:94). In some embodiments, the anti-C10orf54 antibody comprises a VL FR1, VL FR2, VL FR3, and/or VL FR4 of the human germline IGKV3-11*01 (SEQ ID NO:1910) and IGKJ2-1 (SEQ ID NO:94). In some embodiments, the anti-C10orf54 antibody comprises a VL FR1, VL FR2, VL FR3, and/or VL FR4 of the human germline IGKV2-30*01 (SEQ ID NO:1911) and IGKJ2-1 (SEQ ID NO:94). In some embodiments, the anti-C10orf54 antibody comprises a VL FR1, VL FR2, VL FR3, and/or VL FR4 of the human germline IGKV2-30*02 (SEQ ID NO:1912) and IGKJ2-1 (SEQ ID NO:94). In some embodiments, the anti-C10orf54 antibody comprises a VL FR1, VL FR2, VL FR3, and/or VL FR4 of the human germline IGKV4-1*01 (SEQ ID NO:1913) and IGKJ2-1 (SEQ ID NO:94).

TABLE 3

Human Germline Immunoglobulin Amino Acid Sequences

| Human Germline | Amino Acid Sequence | SEQ ID NO: |
|---|---|---|
| Heavy Chain | | |
| IMGT IGHV1-18 | QVQLVQSGAEVKKPGASVKVSCKASGYTFT SYGISWVRQAPGQGLEWMGWISAYNGNTN YAQKLQGRVTMTTDTSTSTAYMELRSLRSD DTAVYYCAR | (SEQ ID NO: 7) |
| IMGT IGHV3-48 | EVQLVESGGGLVQPGGSLRLSCAASGFTFSS YSMNWVRQAPGKGLEWVSYISSSSSTIYYAD SVKGRFTISRDNAKNSLYLQMNSLRAEDTAV YYCAR | (SEQ ID NO: 8) |
| IMGT IGHV1-46*01 | QVQLVQSGAEVKKPGASVKVSCKASGYTFT SYYMHWVRQAPGQGLEWMGIINPSGGSTSY AQKFQGRVTMTRDTSTSTVYMELSSLRSEDT AVYYCAR | (SEQ ID NO: 1902) |
| IMGT IGHV3-74*01 | EVQLVESGGGLVQPGGSLRLSCAASGFTFSS YWMHWVRQAPGKGLVWVSRINSDGSSTSY ADSVKGRFTISRDNAKNTLYLQMNSLRAEDT AVYYCAR | (SEQ ID NO: 1903) |
| IMGT IGHV4-61*01 | QVQLQESGPGLVKPSETLSLTCTVSGGSVSS GSYYWSWIRQPPGKGLEWIGYIYYSGSTNYN PSLKSRVTISVDTSKNQFSLKLSSVTAADTAV YYCAR | (SEQ ID NO: 1904) |
| Joining region IMGT IGHJ4-01 | YFDYWGQGTLVTVSS | (SEQ ID NO: 82) |
| Light Chain | | |
| IMGT IGKV2-28 | DIVMTQSPLSLPVTPGEPASISCRSSQSLLHS NGYNYLDWYLQKPGQSPQLLIYLGSNRASG VPDRFSGSGSGTDFTLKISRVEAEDVGVYYC MQALQTP | (SEQ ID NO: 9) |
| IMGT IGKV2-28*01 | DIVMTQSPLSLPVTPGEPASISCRSSQSLLHS NGYNYLDWYLQKPGQSPQLLIYLGSNRASG VPDRFSGSGSGTDFTLKISRVEAEDVGVYYC MQALQTPP | (SEQ ID NO: 1905) |
| IMGT IGKV2-29*02 | DIVMTQTPLSLSVTPGQPASISCKSSQSLLHS DGKTYLYWYLQKPGQSPQLLIYEVSSRFSGV PDRFSGSGSGTDFTLKISRVEAEDVGVYYCM QGIHLPP | (SEQ ID NO: 1906) |
| IMGT IGKV1-39 | DIQMTQSPSSLSASVGDRVTITCRASQSISSY LNWYQQKPGKAPKLLIYAASSLQSGVPSRFS GSGSGTDFTLTISSLQPEDFATYYCQQSYSTP | (SEQ ID NO: 10) |

TABLE 3-continued

Human Germline Immunoglobulin Amino Acid Sequences

| Human Germline | Amino Acid Sequence | SEQ ID NO: |
|---|---|---|
| IMGT IGKV1-39*01 | DIQMTQSPSSLSASVGDRVTITCRASQSISSY LNWYQQKPGKAPKLLIYAASSLQSGVPSRFS GSGSGTDFTLTISSLQPEDFATYYCQQSYST PP | (SEQ ID NO: 1907) |
| IMGT IGKV3-20 | EIVLTQSPGTLSLSPGERATLSCRASQSVSSS YLAWYQQKPGQAPRLLIYGASSRATGIPDRF SGSGSGTDFTLTISRLEPEDFAVYYCQQYGS SP | (SEQ ID NO: 11) |
| IMGT IGKV3-20*01 | EIVLTQSPGTLSLSPGERATLSCRASQSVSSS YLAWYQQKPGQAPRLLIYGASSRATGIPDRF SGSGSGTDFTLTISRLEPEDFAVYYCQQYGS SPP | (SEQ ID NO: 1908) |
| IMGT IGKV3D-20*01 | EIVLTQSPATLSLSPGERATLSCGASQSVSSS YLAWYQQKPGLAPRLLIYDASSRATGIPDRFS GSGSGTDFTLTISRLEPEDFAVYYCQQYGSS PP | (SEQ ID NO: 1909) |
| IMGT IGKV3-11*01 | EIVLTQSPATLSLSPGERATLSCRASQSVSSY LAWYQQKPGQAPRLLIYDASNRATGIPARFS GSGSGTDFTLTISSLEPEDFAVYYCQQRSNW PP | (SEQ ID NO: 1910) |
| IMGT IGKV2-30*01 | DVVMTQSPLSLPVTLGQPASISCRSSQSLVY SDGNTYLNWFQQRPGQSPRRLIYKVSNRDS GVPDRFSGSGSGTDFTLKISRVEAEDVGVYY CMQGTHWPP | (SEQ ID NO: 1911) |
| IMGT IGKV2-30*02 | DVVMTQSPLSLPVTLGQPASISCRSSQSLVH SDGNTYLNWFQQRPGQSPRRLIYKVSNRDS GVPDRFSGSGSGTDFTLKISRVEAEDVGVYY CMQGTHWPP | (SEQ ID NO: 1912) |
| IMGT IGKV4-1*01 | DIVMTQSPDSLAVSLGERATINCKSSQSVLYS SNNKNYLAWYQQKPGQPPKLLIYWASTRES GVPDRFSGSGSGTDFTLTISSLQAEDVAVYY CQQYYSTPP | (SEQ ID NO: 1913) |
| Joining region IMGT IGKJ2-01 | YTFGQGTKLEIK | (SEQ ID NO: 94) |

*Bold amino acid residues represent CDR sequences (CDR1 - first bolded sequence; CDR2 - second bolded sequence; CDR3 - third bolded sequence)

In certain embodiments, antibodies that bind to C10orf54 (e.g., C10orf54 polypeptide, C10orf54 polypeptide fragment, C10orf54 epitope) comprise a VH domain having an amino acid sequence identified in Table 4 or FIG. 3-8, 22A, 22B, 23A, 23B, 24A, 24B, 25A or 25B and/or a VL domain having an amino acid sequence identified in Table 4 or FIG. 3-8, 22A, 22B, 23A, 23B, 24A, 24B, 25A or 25B.

TABLE 4

Humanized Antibody Amino Acid Sequences of VH and VL Domains

| Murine Clone | Humanized VH Domains (SEQ ID NO:) | Humanized VL Domains (SEQ ID NO:) |
|---|---|---|
| 76E1 | QVQLVQSGAEVKKPGASVKVSCKA SGYSFTGYNMNWVRQAPGQGLEW MGNIDPYYDYTSYNLKFKDRVTMTT DTSTSTAYMELRSLRSDDTAVYYCA RSTMITPFDYWGQGTLVTVSS (SEQ ID NO: 12) | DIVMTQSPLSLPVTPGEPASISCRSSQS IVHSNGNTYLEWYLQKPGQSPQLLIYK VSNRFSGVPDRFSGSGSGTDFTLKISR VEAEDVGVYYCFQGSHVPWTFGQGTK LEIK (SEQ ID NO: 24) |
| | QVQLVQSGAEVKKPGASVKVSCKA SGYSFTGYNMNWVRQAPGQGLEW MGNIDPYYDYTSYAQKLQGRVTMT TDTSTSTAYMELRSLRSDDTAVYYC ARSTMITPFDYWGQGTLVTVSS (SEQ ID NO: 13) | DIQMTQSPSSLSASVGDRVTITCRSSQ SIVHSNGNTYLEWYQQKPGKAPKLLIY KVSNRFSGVPSRFSGSGSGTDFTLTIS SLQPEDFATYYCFQGSHVPWTFGQGT KLEIK (SEQ ID NO: 25) |

TABLE 4-continued

Humanized Antibody Amino Acid Sequences of VH and VL Domains

| Murine Clone | Humanized VH Domains (SEQ ID NO:) | Humanized VL Domains (SEQ ID NO:) |
|---|---|---|
| | EVQLVESGGGLVQPGGSLRLSCAA SGYSFTGYNMNWVRQAPGKGLEW VSNIDPYYDYTSYNLKFKDRFTISRD NAKNSLYLQMNSLRAEDTAVYYCA RSTMITPFDYWGQGTLVTVSS (SEQ ID NO: 14) EVQLVESGGGLVQPGGSLRLSCAA SGYSFTGYNMNWVRQAPGKGLEW VSNIDPYYDYTSYADSVKGRFTISRD NAKNSLYLQMNSLRAEDTAVYYCA RSTMITPFDYWGQGTLVTVSS (SEQ ID NO: 15) | |
| 141A | QVQLVQSGAEVKKPGASVKVSCKA SGYTFSRYWIEWVRQAPGQGLEW MGEILPGSGSTNYNEKFKGRVTMTT DTSTSTAYMELRSLRSDDTAVYYCA REEVYDGYPWFGYWGQGTLVTVS S (SEQ ID NO: 16) QVQLVQSGAEVKKPGASVKVSCKA SGYTFSRYWIEWVRQAPGQGLEW MGEILPGSGSTNYAQKLQGRVTMT TDTSTSTAYMELRSLRSDDTAVYYC AREEVYDGYPWFGYWGQGTLVTV SS (SEQ ID NO: 17) EVQLVESGGGLVQPGGSLRLSCAA SGYTFSRYWIEWVRQAPGKGLEWV SEILPGSGSTNYNEKFKGRFTISRDN AKNSLYLQMNSLRAEDTAVYYCARE EVYDGYPWFGYWGQGTLVTVSS (SEQ ID NO: 18) EVQLVESGGGLVQPGGSLRLSCAA SGYTFSRYWIEWVRQAPGKGLEWV SEILPGSGSTNYADSVKGRFTISRD NAKNSLYLQMNSLRAEDTAVYYCA REEVYDGYPWFGYWGQGTLVTVS S (SEQ ID NO: 19) | EIVLTQSPGTLSLSPGERATLSCRASSS LSYMHWYQQKPGQAPRLLIYATSNLAS GIPDRFSGSGSGTDFTLTISRLEPEDFA VYYCQQWSSNPYTFGQGTKLEIK (SEQ ID NO: 26) DIQMTQSPSSLSASVGDRVTITCRASS SLSYMHWYQQKPGKAPKLLIYATSNLA SGVPSRFSGSGSGTDFTLTISSLQPED FATYYCQQWSSNPYTFGQGTKLEIK (SEQ ID NO: 27) |
| 175A | QVQLVQSGAEVKKPGASVKVSCKA SGYTFSTHWIEWVRQAPGQGLEW MGEILPGSGSTNYNEKFKGRVTMTT DTSTSTAYMELRSLRSDDTAVYYCA RWLLYYYAMDYWGQGTLVTVSS (SEQ ID NO: 20) QVQLVQSGAEVKKPGASVKVSCKA SGYTFSTHWIEWVRQAPGQGLEW MGEILPGSGSTSYAQKLQGRVTMTT DTSTSTAYMELRSLRSDDTAVYYCA RWLLYYYAMDYWGQGTLVTVSS (SEQ ID NO: 21) EVQLVESGGGLVQPGGSLRLSCAA SGYTFSTHWIEWVRQAPGKGLEWV SEILPGSGSTSYNEKFKGRFTISRDN AKNSLYLQMNSLRAEDTAVYYCAR WLLYYYAMDYWGQGTLVTVSS (SEQ ID NO: 22) EVQLVESGGGLVQPGGSLRLSCAA SGYTFSTHWIEWVRQAPGKGLEWV SEILPGSGSTSYADSVKGRFTISRDN AKNSLYLQMNSLRAEDTAVYYCAR WLLYYYAMDYWGQGTLVTVSS (SEQ ID NO: 23) | DIVMTQSPLSLPVTPGEPASISCRSSQS IVHSNGNTYLEWYLQKPGQSPQLLIYK LSNRFSGVPDRFSGSGSGTDFTLKISR VEAEDVGVYYCFQGSHFPYTFGQGTK LEIK (SEQ ID NO: 28) DIQMTQSPSSLSASVGDRVTITCRSSQ SIVHSNGNTYLEWYQQKPGKAPKLLIY KLSNRFSGVPSRFSGSGSGTDFTLTIS SLQPEDFATYYCFQGSHFPYTFGQGT KLEIK (SEQ ID NO: 29) |
| 26A | QVQLVQSGAEVKKPGASVKVSCKA SGFSFTGYTMNWVRQAPGQGLEW MGLISPYNGGTSYAQKFQGRVTMT RDTSTSTVYMELSSLRSEDTAVYYC ARRAYGYAMDYWGQGTLVTVSS (SEQ ID NO: 1529) QVQLVQSGAEVKKPGASVKISCKAS GFSFTGYTMNWVRQAPGQGLEWIG LISPYNGGTSYAQKFQGRATLTVDT STSTAYMELSSLRSEDTAVYYCARR AYGYAMDYWGQGTLVTVSS (SEQ ID NO: 1530) | EIVLTQSPATLSLSPGERATLSCSASSS VSYMYWYQQKPGQAPRLLIYDTSNLA SGIPARFSGSGSGTDFTLTISSLEPEDF AVYYCQQWSSYPFTFGQGTKLEIK (SEQ ID NO: 1532) EIVLTQSPATLSLSPGERVTMSCSASS SVSYMYWYQQKPGQAPRLLIYDTSNL ASGVPARFSGSGSGTDYTLTISSMEPE DFAVYYCQQWSSYPFTFGQGTKLEIK (SEQ ID NO: 1533) |

TABLE 4-continued

Humanized Antibody Amino Acid Sequences of VH and VL Domains

| Murine Clone | Humanized VH Domains (SEQ ID NO:) | Humanized VL Domains (SEQ ID NO:) |
|---|---|---|
| | QVQLVQSGAEVKKPGASVKISCKAS GFSFTGYTMNWVRQAPGQGLEWIG LISPYNGGTSYAQKFQGRATLTVDK STSTAYMELSSLRSEDTAVYYCARR AYGYAMDYWGQGTLVTVSS (SEQ ID NO: 1531) | EIVLTQSPATMSASPGERVTMSCSASS SVSYMYWYQQKPGQAPRLLIYDTSNL ASGVPARFSGSGSGTDYTLTISSMEPE DFAVYYCQQWSSYPFTFGQGTKLEIK (SEQ ID NO: 1534) |
| 128A | QVQLVQSGAEVKKPGASVKVSCKA SGYTFTDYGMHWVRQAPGQGLEW MGLIDTYYGDATYAQKFQGRVTMT RDTSTSTVYMELSSLRSEDTAVYYC ARRAGNAMDYWGQGTLVTVSS (SEQ ID NO: 1535) | DIQMTQSPSSLSASVGDRVTITCKASQ SVSNDIAWYQQKPGKAPKLLIYYASNR YTGVPSRFSGSGSGTDFTLTISSLQPE DFATYYCQQDYSSPRTFGQGTKLEIK (SEQ ID NO: 1538) |
| | QVQLVQSGAEVKKPGASVKISCKGS GYTFTDYGMHWVRQAPGQGLEWI GLIDTYYGDATYAQKFQGRATMTVD TSTSTAYMELSSLRSEDTAVYYCAR RAGNAMDYWGQGTLVTVSS (SEQ ID NO: 1536) | DIQMTQSPSSLSVSVGDRVTITCKASQ SVSNDIAWYQQKPGKAPKLLIYYASNR YTGVPSRFSGSGSGTDFTFTISSVQPE DFATYYCQQDYSSPRTFGQGTKLEIK (SEQ ID NO: 1539) |
| | QVQLVQSGAEVKKPGASVKISCKGS GYTFTDYGMHWVRQAPGQGLEWI GLIDTYYGDATYAQKFQGRATMTVD KSTSTAYMELSSLRSEDTAVYYCAR RAGNAMDYWGQGTLVTVSS (SEQ ID NO: 1537) | DIQMTQSPSSLSVSVGDRVTITCKASQ SVSNDIAWYQQKPGKAPKLLIYYASNR YTGVPSRFSGSGYGTDFTFTISSVQPE DFATYYCQQDYSSPRTFGQGTKLEIK (SEQ ID NO: 1540) |
| 124A | QVQLVQSGAEVKKPGASVKVSCKA SGYTFSSNWIEWVRQAPGQGLEW MGEILPGSGSTSYAQKFQGRVTMT RDTSTSTVYMELSSLRSEDTAVYYC ARWLLYYYAMDFWGQGTLVTVSS (SEQ ID NO: 1541) | DVVMTQSPLSLPVTLGQPASISCRSSQ SIVHNNGNTYLEWFQQRPGQSPRRLIY KVSNRFSGVPDRFSGSGSGTDFTLKIS RVEAEDVGVYYCFQGSHVPYTFGQGT KLEIK (SEQ ID NO: 1546) |
| | QVQLVQSGAEVKKPGASVKISCKAS GYTFSSNWIEWVRQAPGQGLEWM GEILPGSGSTSYAQKFQGRATFTAD TSTSTAYMELSSLRSEDTAVYYCAR WLLYYYAMDFWGQGTLVTVSS (SEQ ID NO: 1542) | DVVMTQSPLSLPVTLGQPASISCRSSQ SIVHNNGNTYLEWYQQRPGQSPRLIY KVSNRFSGVPDRFSGSGSGTDFTLKIS RVEAEDLGVYYCFQGSHVPYTFGQGT KLEIK (SEQ ID NO: 1547) |
| 259A | QVQLVQSGAEVKKPGASVKVSCKA SGYTFTSYFMHWVRQAPGQGLEW MGYIYPYNDGTKYAQKFQGRVTMT RDTSTSTVYMELSSLRSEDTAVYYC ARFDYDTLRYWGQGTLVTVSS (SEQ ID NO: 1543) | DIVMTQSPLSLPVTPGEPASISCKSTKS LLNSDGFTYLDWYLQKPGQSPQLLIYLI SNRFSGVPDRFSGSGSGTDFTLKISRV EAEDVGVYYCFQSNYFPWTFGQGTKL EIK (SEQ ID NO: 1548) |
| | QVQLVQSGAEVKKPGASVKMSCKA SGYTFTSYFMHWVRQAPGQGLEWI GYIYPYNDGTKYAQKFQGRATLTSD TSTSTAYMELSSLRSEDTAVYYCAR FDYDTLRYWGQGTLLTVSS (SEQ ID NO: 1544) | DIVLTQSPLSLPVTPGEPASISCKSTKS LLNSDGFTYLDWYLQKPGQSPQLLIYLI SNRFSGVPDRFSGSGSGTDFTLKISRV EAEDLGVYYCFQSNYFPWTFGQGTKL EIK (SEQ ID NO: 1549) |
| | QVQLVQSGAEVKKPGASVKMSCKA SGYTFTSYFMHWVRQAPGQGLEWI GYIYPYNDGTKYAQKFQGRATLTSD KSTSTAYMELSSLRSEDTAVYYCAR FDYDTLRYWGQGTLLTVSS (SEQ ID NO: 1545) | |

Accordingly, in some embodiments, antibodies that bind to C10orf54 (e.g., C10orf54 polypeptide, C10orf54 polypeptide fragment, C10orf54 epitope) comprise a VH domain having the amino acid sequence of SEQ ID NOS:20, 21, 22, 23, 1529-1531, 1535-1537, or 1541-1545 and/or a VL domain having the amino acid sequence of SEQ ID NO:28, 29, 1532-1534, 1538-1540, or 1546-1549. In one embodiment, an antibody that binds to C10orf54 (e.g., C10orf54 polypeptide, C10orf54 polypeptide fragment, C10orf54 epitope) comprises a VH domain having the amino acid sequence of SEQ ID NO:20 and/or a VL domain having the amino acid sequence of SEQ ID NO:28. In one aspect an antibody that binds to C10orf54 (e.g., C10orf54 polypeptide, C10orf54 polypeptide fragment, C10orf54 epitope) comprises a VH domain having the amino acid sequence of SEQ ID NO:21 and/or a VL domain having the amino acid sequence of SEQ ID NO:28. In one aspect an antibody that binds to C10orf54 (e.g., C10orf54 polypeptide, C10orf54 polypeptide fragment, C10orf54 epitope) comprises a VH domain having the amino acid sequence of SEQ ID NO:22 and/or a VL domain having the amino acid sequence of SEQ ID NO:28. In one aspect an antibody that binds to C10orf54 (e.g., C10orf54 polypeptide, C10orf54 polypeptide fragment, C10orf54 epitope) comprises a VH domain having the amino acid sequence of SEQ ID NO:23 and/or a VL domain having the amino acid sequence of SEQ ID NO:28. In one aspect an antibody that binds to C10orf54 (e.g., C10orf54 polypeptide, C10orf54 polypeptide fragment, C10orf54 epitope) comprises a VH domain having the amino acid sequence of SEQ ID NO:20 and/or a VL domain having the amino acid sequence of SEQ ID NO:29. In one aspect an antibody that binds to C10orf54 (e.g., C10orf54 polypeptide, C10orf54 polypeptide fragment, C10orf54 epitope) comprises a VH domain having the amino acid sequence of SEQ ID NO:21 and/or a VL domain having the amino acid sequence of SEQ ID NO:29. In one aspect an antibody that binds to C10orf54 (e.g., C10orf54 polypeptide, C10orf54 polypeptide fragment, C10orf54 epitope) comprises a VH domain having the amino acid sequence of SEQ ID NO:22 and/or a VL domain having the amino acid sequence of SEQ ID NO:29. In one aspect an antibody that binds to C10orf54 (e.g., C10orf54 polypeptide, C10orf54 polypeptide fragment, C10orf54 epitope) comprises a VH domain having the amino acid sequence of SEQ ID NO:23 and/or a VL domain having the amino acid sequence of SEQ ID NO:29.

In some embodiments, antibodies that bind to C10orf54 (e.g., C10orf54 polypeptide, C10orf54 polypeptide fragment, C10orf54 epitope) comprise a VH domain having the amino acid sequence of SEQ ID NOS:12, 13, 14 or 15 and/or a VL domain having the amino acid sequence of SEQ ID NO:24 or 25. Accordingly, in one aspect an antibody that binds to C10orf54 (e.g., C10orf54 polypeptide, C10orf54 polypeptide fragment, C10orf54 epitope) comprises a VH domain having the amino acid sequence of SEQ ID NO:12 and/or a VL domain having the amino acid sequence of SEQ ID NO:24. In one aspect an antibody that binds to C10orf54 (e.g., C10orf54 polypeptide, C10orf54 polypeptide fragment, C10orf54 epitope) comprises a VH domain having the amino acid sequence of SEQ ID NO:13 and/or a VL domain having the amino acid sequence of SEQ ID NO:24. In one aspect an antibody that binds to C10orf54 (e.g., C10orf54 polypeptide, C10orf54 polypeptide fragment, C10orf54 epitope) comprises a VH domain having the amino acid sequence of SEQ ID NO:14 and/or a VL domain having the amino acid sequence of SEQ ID NO:24. In one aspect an antibody that binds to C10orf54 (e.g., C10orf54 polypeptide, C10orf54 polypeptide fragment, C10orf54 epitope) comprises a VH domain having the amino acid sequence of SEQ ID NO:15 and/or a VL domain having the amino acid sequence of SEQ ID NO:24. In one aspect an antibody that binds to C10orf54 (e.g., C10orf54 polypeptide, C10orf54 polypeptide fragment, C10orf54 epitope) comprises a VH domain having the amino acid sequence of SEQ ID NO:12 and/or a VL domain having the amino acid sequence of SEQ ID NO:25. In one aspect an antibody that binds to C10orf54 (e.g., C10orf54 polypeptide, C10orf54 polypeptide fragment, C10orf54 epitope) comprises a VH domain having the amino acid sequence of SEQ ID NO:13 and/or a VL domain having the amino acid sequence of SEQ ID NO:25. In one aspect an antibody that binds to C10orf54 (e.g., C10orf54 polypeptide, C10orf54 polypeptide fragment, C10orf54 epitope) comprises a VH domain having the amino acid sequence of SEQ ID NO:14 and/or a VL domain having the amino acid sequence of SEQ ID NO:25. In one aspect an antibody that binds to C10orf54 (e.g., C10orf54 polypeptide, C10orf54 polypeptide fragment, C10orf54 epitope) comprises a VH domain having the amino acid sequence of SEQ ID NO:15 and/or a VL domain having the amino acid sequence of SEQ ID NO:25.

In some embodiments, antibodies that bind to C10orf54 (e.g., C10orf54 polypeptide, C10orf54 polypeptide fragment, C10orf54 epitope) comprise a VH domain having the amino acid sequence of SEQ ID NOS:16, 17, 18 or 19 and/or a VL domain having the amino acid sequence of SEQ ID NO:26 or 27. Accordingly, in one aspect an antibody that binds to C10orf54 (e.g., C10orf54 polypeptide, C10orf54 polypeptide fragment, C10orf54 epitope) comprises a VH domain having the amino acid sequence of SEQ ID NO:16 and/or a VL domain having the amino acid sequence of SEQ ID NO:26. In one aspect an antibody that binds to C10orf54 (e.g., C10orf54 polypeptide, C10orf54 polypeptide fragment, C10orf54 epitope) comprises a VH domain having the amino acid sequence of SEQ ID NO:17 and/or a VL domain having the amino acid sequence of SEQ ID NO:26. In one aspect an antibody that binds to C10orf54 (e.g., C10orf54 polypeptide, C10orf54 polypeptide fragment, C10orf54 epitope) comprises a VH domain having the amino acid sequence of SEQ ID NO:18 and/or a VL domain having the amino acid sequence of SEQ ID NO:26. In one aspect an antibody that binds to C10orf54 (e.g., C10orf54 polypeptide, C10orf54 polypeptide fragment, C10orf54 epitope) comprises a VH domain having the amino acid sequence of SEQ ID NO:19 and/or a VL domain having the amino acid sequence of SEQ ID NO:26. In one aspect an antibody that binds to C10orf54 (e.g., C10orf54 polypeptide, C10orf54 polypeptide fragment, C10orf54 epitope) comprises a VH domain having the amino acid sequence of SEQ ID NO:16 and/or a VL domain having the amino acid sequence of SEQ ID NO:27. In one aspect an antibody that binds to C10orf54 (e.g., C10orf54 polypeptide, C10orf54 polypeptide fragment, C10orf54 epitope) comprises a VH domain having the amino acid sequence of SEQ ID NO:17 and/or a VL domain having the amino acid sequence of SEQ ID NO:27. In one aspect an antibody that binds to C10orf54 (e.g., C10orf54 polypeptide, C10orf54 polypeptide fragment, C10orf54 epitope) comprises a VH domain having the amino acid sequence of SEQ ID NO:18 and/or a VL domain having the amino acid sequence of SEQ ID NO:27. In one aspect an antibody that binds to C10orf54 (e.g., C10orf54 polypeptide, C10orf54 polypeptide fragment, C10orf54 epitope) comprises a VH domain having the amino acid sequence of SEQ ID NO:19 and/or a VL domain having the amino acid sequence of SEQ ID NO:27.

In certain embodiments, antibodies provided herein that bind to a C10orf54 epitope comprise a VH region having a VH CDR1, VH CDR2, and/or VH CDR3, that have an amino acid sequence identified in Tables 5-11 or Tables 12-33 below; and/or a VL region having VL CDR1, VL CDR 2 and/or VL CDR3 that have an amino acid sequence identified in Tables 5-11 or Tables 12-33 below.

TABLE 5

Amino Acid Sequences derived from Murine 175A Antibody.

175A HUMANIZED ANTIBODY SEQUENCE: HEAVY CHAIN
175A-huVH1a Variable Region
QVQLVQSGAEVKKPGASVKVSCKASGYTFSTHWIEWVRQAPGQGLEWMGE
ILPGSGSTSYNEKFKGRVTMTTDTSTSTAYMELRSLRSDDTAVYYCARWL
LYYYAMDYWGQGTLVTVSS (SEQ ID NO: 20)

175A-huVH1a VH FR1
QVQLVQSGAEVKKPGASVKVSCKAS (SEQ ID NO: 51)
QVQLVQSGAEVKKPGASVKISCKAS (SEQ ID NO: 105)

175A-huVH1a VH CDR1
GYTFSTHWIE (SEQ ID NO: 36)

175A-huVH1a VH FR2
WVRQAPGQGLEWMG (SEQ ID NO: 52)
WVRQAPGQGLEWIG (SEQ ID NO: 106)

TABLE 5-continued

Amino Acid Sequences derived
from Murine 175A Antibody.

175A-huVH1a VH CDR2
EILPGSGSTSYNEKFKG (SEQ ID NO: 37)
EILPGSGSTSYQEKFKG (SEQ ID NO: 101)
EILPGSGSTSYSEKFKG (SEQ ID NO: 102)
EILPGSGSTSYDEKFKG (SEQ ID NO: 103)
EILPGSGSTSYAEKFKG (SEQ ID NO: 104)

175A-huVH1a VH FR3
RVTMTTDTSTSTAYMELRSLRSDDTAVYYCAR (SEQ ID NO: 53)
RATMTTDTSTSTAYMELRSLRSDDTAVYYCAR (SEQ ID NO: 107)
RVTFTTDTSTSTAYMELRSLRSDDTAVYYCAR (SEQ ID NO: 108)
RVTMTADTSTSTAYMELRSLRSDDTAVYYCAR (SEQ ID NO: 109)
RATFTTDTSTSTAYMELRSLRSDDTAVYYCAR (SEQ ID NO: 110)
RVTFTADTSTSTAYMELRSLRSDDTAVYYCAR (SEQ ID NO: 111)
RATMTADTSTSTAYMELRSLRSDDTAVYYCAR (SEQ ID NO: 112)
RATFTADTSTSTAYMELRSLRSDDTAVYYCAR (SEQ ID NO: 113)

175A-huVH1a VH CDR3
WLLYYYAMDY (SEQ ID NO: 38)

175A-huVH1a VH FR4
WGQGTLVTVSS (SEQ ID NO: 54)

175A-huVH1b Variable Region
QVQLVQSGAEVKKPGASVKVSCKASGYTFSTHWIEWVRQAPGQGLEWMGE
ILPGSGSTSYAQKLQGRVTMTTDTSTSTAYMELRSLRSDDTAVYYCARWL
LYYYAMDYWGQGTLVTVSS (SEQ ID NO: 21)

175A-huVH1b VH FR1
QVQLVQSGAEVKKPGASVKVSCKAS (SEQ ID NO: 51)
QVQLVQSGAEVKKPGASVKISCKAS (SEQ ID NO: 105)

175A-huVH1b VH CDR1
GYTFSTHWIE (SEQ ID NO: 36)

175A-huVH1b VH FR2
WVRQAPGQGLEWMG (SEQ ID NO: 52)
WVRQAPGQGLEWIG (SEQ ID NO: 106)

175A-huVH1b VH CDR2*
EILPGSGSTSYAQKLQG (SEQ ID NO: 50)
EILPGSGSTSYAQKFQG (SEQ ID NO: 114)

175A-huVH1b VH FR3
RVTMTTDTSTSTAYMELRSLRSDDTAVYYCAR (SEQ ID NO: 53)
RATMTTDTSTSTAYMELRSLRSDDTAVYYCAR (SEQ ID NO: 107)
RVTFTTDTSTSTAYMELRSLRSDDTAVYYCAR (SEQ ID NO: 108)
RVTMTADTSTSTAYMELRSLRSDDTAVYYCAR (SEQ ID NO: 109)
RATFTTDTSTSTAYMELRSLRSDDTAVYYCAR (SEQ ID NO: 110)
RVTFTADTSTSTAYMELRSLRSDDTAVYYCAR (SEQ ID NO: 111)
RATMTADTSTSTAYMELRSLRSDDTAVYYCAR (SEQ ID NO: 112)
RATFTADTSTSTAYMELRSLRSDDTAVYYCAR (SEQ ID NO: 113)

175A-huVH1b VH CDR3
WLLYYYAMDY (SEQ ID NO: 38)

175A-huVH1b VH FR4
WGQGTLVTVSS (SEQ ID NO: 54)

175A-huVH3a Variable Region
EVQLVESGGGLVQPGGSLRLSCAASGYTFSTHWIEWVRQAPGKGLEWVSE
ILPGSGSTSYNEKFKGRFTISRDNAKNSLYLQMNSLRAEDTAVYYCARWL
LYYYAMDYWGQGTLVTVSS (SEQ ID NO: 22)

175A-huVH3a VH FR1
EVQLVESGGGLVQPGGSLRLSCAAS (SEQ ID NO: 55)
EVQLVQSGGGLVQPGGSLRLSCAAS (SEQ ID NO: 115)
EVQLVESGGGLVQPGGSVRLSCAAS (SEQ ID NO: 116)
EVQLVESGGGLVQPGGSLRISCAAS (SEQ ID NO: 117)
EVQLVQSGGGLVQPGGSVRLSCAAS (SEQ ID NO: 118)
EVQLVESGGGLVQPGGSVRISCAAS (SEQ ID NO: 119)
EVQLVQSGGGLVQPGGSLRISCAAS (SEQ ID NO: 120)
EVQLVQSGGGLVQPGGSVRISCAAS (SEQ ID NO: 121)

175A-huVH3a VH CDR1
GYTFSTHWIE (SEQ ID NO: 36)

TABLE 5-continued

Amino Acid Sequences derived
from Murine 175A Antibody.

175A-huVH3a VH FR2
WVRQAPGKGLEWVS (SEQ ID NO: 56)
WVRQAPGKGLEWIS (SEQ ID NO: 122)
WVRQAPGKGLEWVG (SEQ ID NO: 123)
WVRQAPGKGLEWIG (SEQ ID NO: 124)

175A-huVH3a VH CDR2
EILPGSGSTSYNEKFKG (SEQ ID NO: 37)
EILPGSGSTSYQEKFKG (SEQ ID NO: 101)
EILPGSGSTSYSEKFKG (SEQ ID NO: 102)
EILPGSGSTSYDEKFKG (SEQ ID NO: 103)
EILPGSGSTSYAEKFKG (SEQ ID NO: 104)

175A-huVH3a VH FR3
RFTISRDNAKNSLYLQMNSLRAEDTAVYYCAR (SEQ ID NO: 57)
RATISRDNAKNSLYLQMNSLRAEDTAVYYCAR (SEQ ID NO: 125)
RFTFSRDNAKNSLYLQMNSLRAEDTAVYYCAR (SEQ ID NO: 126)
RFTISADNAKNSLYLQMNSLRAEDTAVYYCAR (SEQ ID NO: 127)
RFTISRDTAKNSLYLQMNSLRAEDTAVYYCAR (SEQ ID NO: 128)
RFTISRDNAKNSAYLQMNSLRAEDTAVYYCAR (SEQ ID NO: 129)
RFTISRDNAKNSLYMQMNSLRAEDTAVYYCAR (SEQ ID NO: 130)
RFTISRDNAKNSLYLQLNSLRAEDTAVYYCAR (SEQ ID NO: 131)
RATFSRDNAKNSLYLQMNSLRAEDTAVYYCAR (SEQ ID NO: 132)
RATISADNAKNSLYLQMNSLRAEDTAVYYCAR (SEQ ID NO: 133)
RATISRDTAKNSLYLQMNSLRAEDTAVYYCAR (SEQ ID NO: 134)
RATISRDNAKNSAYLQMNSLRAEDTAVYYCAR (SEQ ID NO: 135)
RATISRDNAKNSLYMQMNSLRAEDTAVYYCAR (SEQ ID NO: 136)
RATISRDNAKNSLYLQLNSLRAEDTAVYYCAR (SEQ ID NO: 137)
RFTFSADNAKNSLYLQMNSLRAEDTAVYYCAR (SEQ ID NO: 138)
RFTFSRDTAKNSLYLQMNSLRAEDTAVYYCAR (SEQ ID NO: 139)
RFTFSRDNAKNSAYLQMNSLRAEDTAVYYCAR (SEQ ID NO: 140)
RFTFSRDNAKNSLYMQMNSLRAEDTAVYYCAR (SEQ ID NO: 141)
RFTFSRDNAKNSLYLQLNSLRAEDTAVYYCAR (SEQ ID NO: 142)
RFTISADTAKNSLYLQMNSLRAEDTAVYYCAR (SEQ ID NO: 143)
RFTISADNAKNSAYLQMNSLRAEDTAVYYCAR (SEQ ID NO: 144)
RFTISADNAKNSLYMQMNSLRAEDTAVYYCAR (SEQ ID NO: 145)
RFTISADNAKNSLYLQLNSLRAEDTAVYYCAR (SEQ ID NO: 146)
RFTISRDTAKNSAYLQMNSLRAEDTAVYYCAR (SEQ ID NO: 147)
RFTISRDTAKNSLYMQMNSLRAEDTAVYYCAR (SEQ ID NO: 148)
RFTISRDTAKNSLYLQLNSLRAEDTAVYYCAR (SEQ ID NO: 149)
RFTISRDNAKNSAYMQMNSLRAEDTAVYYCAR (SEQ ID NO: 150)
RFTISRDNAKNSAYLQLNSLRAEDTAVYYCAR (SEQ ID NO: 151)
RFTISRDNAKNSLYMQLNSLRAEDTAVYYCAR (SEQ ID NO: 152)
RATFSADNAKNSLYLQMNSLRAEDTAVYYCAR (SEQ ID NO: 153)
RATFSRDTAKNSLYLQMNSLRAEDTAVYYCAR (SEQ ID NO: 154)
RATFSRDNAKNSAYLQMNSLRAEDTAVYYCAR (SEQ ID NO: 155)
RATFSRDNAKNSLYMQMNSLRAEDTAVYYCAR (SEQ ID NO: 156)
RATFSRDNAKNSLYLQLNSLRAEDTAVYYCAR (SEQ ID NO: 157)
RATISADTAKNSLYLQMNSLRAEDTAVYYCAR (SEQ ID NO: 158)
RATISADNAKNSAYLQMNSLRAEDTAVYYCAR (SEQ ID NO: 159)
RATISADNAKNSLYMQMNSLRAEDTAVYYCAR (SEQ ID NO: 160)
RATISADNAKNSLYLQLNSLRAEDTAVYYCAR (SEQ ID NO: 161)
RATISRDTAKNSAYLQMNSLRAEDTAVYYCAR (SEQ ID NO: 162)
RATISRDTAKNSLYMQMNSLRAEDTAVYYCAR (SEQ ID NO: 163)
RATISRDTAKNSLYLQLNSLRAEDTAVYYCAR (SEQ ID NO: 164)
RATISRDNAKNSAYMQMNSLRAEDTAVYYCAR (SEQ ID NO: 165)
RATISRDNAKNSAYLQLNSLRAEDTAVYYCAR (SEQ ID NO: 166)
RATISRDNAKNSLYMQLNSLRAEDTAVYYCAR (SEQ ID NO: 167)
RFTFSADTAKNSLYLQMNSLRAEDTAVYYCAR (SEQ ID NO: 168)
RFTFSADNAKNSAYLQMNSLRAEDTAVYYCAR (SEQ ID NO: 169)
RFTFSADNAKNSLYMQMNSLRAEDTAVYYCAR (SEQ ID NO: 170)
RFTFSADNAKNSLYLQLNSLRAEDTAVYYCAR (SEQ ID NO: 171)
RFTFSRDTAKNSAYLQMNSLRAEDTAVYYCAR (SEQ ID NO: 172)
RFTFSRDTAKNSLYMQMNSLRAEDTAVYYCAR (SEQ ID NO: 173)
RFTFSRDTAKNSLYLQLNSLRAEDTAVYYCAR (SEQ ID NO: 174)
RFTFSRDNAKNSAYMQMNSLRAEDTAVYYCAR (SEQ ID NO: 175)
RFTFSRDNAKNSAYLQLNSLRAEDTAVYYCAR (SEQ ID NO: 176)
RFTFSRDNAKNSLYMQLNSLRAEDTAVYYCAR (SEQ ID NO: 177)
RFTISADTAKNSAYLQMNSLRAEDTAVYYCAR (SEQ ID NO: 178)
RFTISADTAKNSLYMQMNSLRAEDTAVYYCAR (SEQ ID NO: 179)
RFTISADTAKNSLYLQLNSLRAEDTAVYYCAR (SEQ ID NO: 180)
RFTISADNAKNSAYMQMNSLRAEDTAVYYCAR (SEQ ID NO: 181)
RFTISADNAKNSAYLQLNSLRAEDTAVYYCAR (SEQ ID NO: 182)
RFTISADNAKNSLYMQLNSLRAEDTAVYYCAR (SEQ ID NO: 183)
RFTISRDTAKNSAYMQMNSLRAEDTAVYYCAR (SEQ ID NO: 184)
RFTISRDTAKNSAYLQLNSLRAEDTAVYYCAR (SEQ ID NO: 185)
RFTISRDTAKNSLYMQLNSLRAEDTAVYYCAR (SEQ ID NO: 186)

TABLE 5-continued

Amino Acid Sequences derived from Murine 175A Antibody.

RFTISRDNAKNSAYMQLNSLRAEDTAVYYCAR (SEQ ID NO: 187)
RATFSADTAKNSLYLQMNSLRAEDTAVYYCAR (SEQ ID NO: 188)
RATFSADNAKNSAYLQMNSLRAEDTAVYYCAR (SEQ ID NO: 189)
RATFSADNAKNSLYMQMNSLRAEDTAVYYCAR (SEQ ID NO: 190)
RATFSADNAKNSLYLQLNSLRAEDTAVYYCAR (SEQ ID NO: 191)
RATFSRDTAKNSAYLQMNSLRAEDTAVYYCAR (SEQ ID NO: 192)
RATFSRDTAKNSLYMQMNSLRAEDTAVYYCAR (SEQ ID NO: 193)
RATFSRDTAKNSLYLQLNSLRAEDTAVYYCAR (SEQ ID NO: 194)
RATFSRDNAKNSAYMQLNSLRAEDTAVYYCAR (SEQ ID NO: 195)
RATFSRDNAKNSAYLQLNSLRAEDTAVYYCAR (SEQ ID NO: 196)
RATFSRDNAKNSLYMQLNSLRAEDTAVYYCAR (SEQ ID NO: 197)
RATISADTAKNALYLQMNSLRAEDTAVYYCAR (SEQ ID NO: 198)
RATISADTAKNSLYMQMNSLRAEDTAVYYCAR (SEQ ID NO: 199)
RATISADTAKNSLYLQLNSLRAEDTAVYYCAR (SEQ ID NO: 200)
RATISADNAKNSAYMQMNSLRAEDTAVYYCAR (SEQ ID NO: 201)
RATISADNAKNSAYLQLNSLRAEDTAVYYCAR (SEQ ID NO: 202)
RATISADNAKNSLYMQLNSLRAEDTAVYYCAR (SEQ ID NO: 203)
RATISRDTAKNSAYMQMNSLRAEDTAVYYCAR (SEQ ID NO: 204)
RATISRDTAKNSAYLQLNSLRAEDTAVYYCAR (SEQ ID NO: 205)
RATISRDTAKNSLYMQLNSLRAEDTAVYYCAR (SEQ ID NO: 206)
RATISRDNAKNSAYMQLNSLRAEDTAVYYCAR (SEQ ID NO: 207)
RFTFSADTAKNSAYMQMNSLRAEDTAVYYCAR (SEQ ID NO: 208)
RFTFSADTAKNSLYLQLNSLRAEDTAVYYCAR (SEQ ID NO: 209)
RFTFSADTAKNSLYLQLNSLRAEDTAVYYCAR (SEQ ID NO: 210)
RFTFSADNAKNSAYMQMNSLRAEDTAVYYCAR (SEQ ID NO: 211)
RFTFSADNAKNSAYLQLNSLRAEDTAVYYCAR (SEQ ID NO: 212)
RFTFSADNAKNSLYMQLNSLRAEDTAVYYCAR (SEQ ID NO: 213)
RFTFSRDTAKNSAYMQMNSLRAEDTAVYYCAR (SEQ ID NO: 214)
RFTFSRDTAKNSAYLQLNSLRAEDTAVYYCAR (SEQ ID NO: 215)
RFTFSRDTAKNSLYMQLNSLRAEDTAVYYCAR (SEQ ID NO: 216)
RFTFSRDNAKNSAYMQLNSLRAEDTAVYYCAR (SEQ ID NO: 217)
RFTISADTAKNSAYMQMNSLRAEDTAVYYCAR (SEQ ID NO: 218)
RFTISADTAKNSAYLQLNSLRAEDTAVYYCAR (SEQ ID NO: 219)
RFTISADTAKNSLYMQLNSLRAEDTAVYYCAR (SEQ ID NO: 220)
RFTISADNAKNSAYMQLNSLRAEDTAVYYCAR (SEQ ID NO: 221)
RFTISRDTAKNSAYMQLNSLRAEDTAVYYCAR (SEQ ID NO: 222)
RATFSADTAKNSAYLQMNSLRAEDTAVYYCAR (SEQ ID NO: 223)
RATFSADTAKNSLYMQMNSLRAEDTAVYYCAR (SEQ ID NO: 224)
RATFSADTAKNSLYLQLNSLRAEDTAVYYCAR (SEQ ID NO: 225)
RATFSADNAKNSAYMQMNSLRAEDTAVYYCAR (SEQ ID NO: 226)
RATFSADNAKNSAYLQLNSLRAEDTAVYYCAR (SEQ ID NO: 227)
RATFSADNAKNSLYMQLNSLRAEDTAVYYCAR (SEQ ID NO: 228)
RATFSRDTAKNSAYMQMNSLRAEDTAVYYCAR (SEQ ID NO: 229)
RATFSRDTAKNSAYLQLNSLRAEDTAVYYCAR (SEQ ID NO: 230)
RATFSRDTAKNSLYMQLNSLRAEDTAVYYCAR (SEQ ID NO: 231)
RATFSRDNAKNSAYMQLNSLRAEDTAVYYCAR (SEQ ID NO: 232)
RATISADTAKNALYMQMNSLRAEDTAVYYCAR (SEQ ID NO: 233)
RATISADTAKNALYLQLNSLRAEDTAVYYCAR (SEQ ID NO: 234)
RATISADTAKNSLYMQLNSLRAEDTAVYYCAR (SEQ ID NO: 235)
RATISADNAKNSAYMQLNSLRAEDTAVYYCAR (SEQ ID NO: 236)
RATISRDTAKNSAYMQLNSLRAEDTAVYYCAR (SEQ ID NO: 237)
RFTFSADTAKNSAYMQLNSLRAEDTAVYYCAR (SEQ ID NO: 238)
RFTFSADTAKNSLYMQLNSLRAEDTAVYYCAR (SEQ ID NO: 239)
RFTFSADTAKNSLYMQLNSLRAEDTAVYYCAR (SEQ ID NO: 240)
RFTFSADNAKNSAYMQLNSLRAEDTAVYYCAR (SEQ ID NO: 241)
RFTFSRDTAKNSAYMQLNSLRAEDTAVYYCAR (SEQ ID NO: 242)
RFTISADTAKNSAYMQLNSLRAEDTAVYYCAR (SEQ ID NO: 243)
RATFSADTAKNSAYMQLNSLRAEDTAVYYCAR (SEQ ID NO: 244)
RATFSADTAKNSLYQLNSLRAEDTAVYYCAR (SEQ ID NO: 245)
RATFSADTAKNSLYMQLNSLRAEDTAVYYCAR (SEQ ID NO: 246)
RATFSADNAKNSAYMQLNSLRAEDTAVYYCAR (SEQ ID NO: 247)
RATFSRDTAKNSAYMQLNSLRAEDTAVYYCAR (SEQ ID NO: 248)
RATISADTAKNALYMQLNSLRAEDTAVYYCAR (SEQ ID NO: 249)
RFTFSADTAKNSAYMQLNSLRAEDTAVYYCAR (SEQ ID NO: 250)
RATFSADTAKNSAYMQLNSLRAEDTAVYYCAR (SEQ ID NO: 251)

175A-huVH3a VH CDR3
WLLYYYAMDY (SEQ ID NO: 38)

175A-huVH3a VH FR4
WGQGTLVTVSS (SEQ ID NO: 54)

175A-huVH3b Variable Region
EVQLVESGGGLVQPGGSLRLSCAASGYTFSTHWIEWVRQAPGKGLEWVSE
ILPGSGSTSYADSVKGRFTISRDNAKNSLYLQMNSLRAEDTAVYYCARWL
LYYYAMDYWGQGTLVTVSS (SEQ ID NO: 23)

175A-huVH3b VH FR1
EVQLVESGGGLVQPGGSLRLSCAAS (SEQ ID NO: 55)
EVQLVQSGGGLVQPGGSLRLSCAAS (SEQ ID NO: 115)
EVQLVESGGGLVQPGGSVRLSCAAS (SEQ ID NO: 116)
EVQLVESGGGLVQPGGSLRISCAAS (SEQ ID NO: 117)
EVQLVQSGGGLVQPGGSVRLSCAAS (SEQ ID NO: 118)
EVQLVESGGGLVQPGGSVRISCAAS (SEQ ID NO: 119)
EVQLVQSGGGLVQPGGSLRISCAAS (SEQ ID NO: 120)
EVQLVQSGGGLVQPGGSVRISCAAS (SEQ ID NO: 121)

175A-huVH3b VH CDR1
GYTFSTHWIE (SEQ ID NO: 36)

175A-huVH3b VH FR2
WVRQAPGKGLEWVS (SEQ ID NO: 56)
WVRQAPGKGLEWIS (SEQ ID NO: 122)
WVRQAPGKGLEWVG (SEQ ID NO: 123)
WVRQAPGKGLEWIG (SEQ ID NO: 124)

175A-huVH3b VH CDR2*
EILPGSGSTSYADSVKG (SEQ ID NO: 99)
EILPGSGSTSYADSFKG (SEQ ID NO: 100)

175A-huVH3b VH FR3
RFTISRDNAKNSLYLQMNSLRAEDTAVYYCAR (SEQ ID NO: 57)
RATISRDNAKNSLYLQMNSLRAEDTAVYYCAR (SEQ ID NO: 125)
RFTFSRDNAKNSLYLQMNSLRAEDTAVYYCAR (SEQ ID NO: 126)
RFTISADTAKNSLYLQMNSLRAEDTAVYYCAR (SEQ ID NO: 127)
RFTISRDTAKNSLYLQMNSLRAEDTAVYYCAR (SEQ ID NO: 128)
RFTISRDNAKNSAYLQMNSLRAEDTAVYYCAR (SEQ ID NO: 129)
RFTISRDNAKNSLYMQMNSLRAEDTAVYYCAR (SEQ ID NO: 130)
RFTISRDNAKNSLYLQLNSLRAEDTAVYYCAR (SEQ ID NO: 131)
RATFSRDNAKNSLYLQMNSLRAEDTAVYYCAR (SEQ ID NO: 132)
RATISADTAKNSLYLQMNSLRAEDTAVYYCAR (SEQ ID NO: 133)
RATISRDTAKNSLYLQMNSLRAEDTAVYYCAR (SEQ ID NO: 134)
RATISRDNAKNSAYLQMNSLRAEDTAVYYCAR (SEQ ID NO: 135)
RATISRDNAKNSLYMQMNSLRAEDTAVYYCAR (SEQ ID NO: 136)
RATISRDNAKNSLYLQLNSLRAEDTAVYYCAR (SEQ ID NO: 137)
RFTFSADTAKNSLYLQMNSLRAEDTAVYYCAR (SEQ ID NO: 138)
RFTFSRDTAKNSLYLQMNSLRAEDTAVYYCAR (SEQ ID NO: 139)
RFTFSRDNAKNSAYLQMNSLRAEDTAVYYCAR (SEQ ID NO: 140)
RFTFSRDNAKNSLYMQMNSLRAEDTAVYYCAR (SEQ ID NO: 141)
RFTFSRDNAKNSLYLQLNSLRAEDTAVYYCAR (SEQ ID NO: 142)
RFTISADTAKNSLYLQMNSLRAEDTAVYYCAR (SEQ ID NO: 143)
RFTISADTAKNSAYLQMNSLRAEDTAVYYCAR (SEQ ID NO: 144)
RFTISADNAKNSLYMQMNSLRAEDTAVYYCAR (SEQ ID NO: 145)
RFTISADNAKNSLYLQLNSLRAEDTAVYYCAR (SEQ ID NO: 146)
RFTISRDTAKNSAYLQMNSLRAEDTAVYYCAR (SEQ ID NO: 147)
RFTISRDTAKNSLYMQMNSLRAEDTAVYYCAR (SEQ ID NO: 148)
RFTISRDTAKNSLYLQLNSLRAEDTAVYYCAR (SEQ ID NO: 149)
RFTISRDNAKNSAYMQMNSLRAEDTAVYYCAR (SEQ ID NO: 150)
RFTISRDNAKNSAYLQLNSLRAEDTAVYYCAR (SEQ ID NO: 151)
RFTISRDNAKNSLYMQLNSLRAEDTAVYYCAR (SEQ ID NO: 152)
RATFSADTAKNSLYLQMNSLRAEDTAVYYCAR (SEQ ID NO: 153)
RATFSRDTAKNSLYLQMNSLRAEDTAVYYCAR (SEQ ID NO: 154)
RATFSRDNAKNSAYLQMNSLRAEDTAVYYCAR (SEQ ID NO: 155)
RATFSRDNAKNSLYMQMNSLRAEDTAVYYCAR (SEQ ID NO: 156)
RATFSRDNAKNSLYLQLNSLRAEDTAVYYCAR (SEQ ID NO: 157)
RATISADTAKNSAYLQMNSLRAEDTAVYYCAR (SEQ ID NO: 158)
RATISADNAKNSLYMQMNSLRAEDTAVYYCAR (SEQ ID NO: 159)
RATISADNAKNSLYMQMNSLRAEDTAVYYCAR (SEQ ID NO: 160)
RATISADNAKNSLYLQLNSLRAEDTAVYYCAR (SEQ ID NO: 161)
RATISRDTAKNSAYLQMNSLRAEDTAVYYCAR (SEQ ID NO: 162)
RATISRDTAKNSLYMQMNSLRAEDTAVYYCAR (SEQ ID NO: 163)
RATISRDTAKNSLYLQLNSLRAEDTAVYYCAR (SEQ ID NO: 164)
RATISRDNAKNSAYMQMNSLRAEDTAVYYCAR (SEQ ID NO: 165)
RATISRDNAKNSAYLQLNSLRAEDTAVYYCAR (SEQ ID NO: 166)
RATISRDNAKNSLYMQLNSLRAEDTAVYYCAR (SEQ ID NO: 167)
RFTFSADTAKNSAYLQMNSLRAEDTAVYYCAR (SEQ ID NO: 168)
RFTFSADNAKNSLYMQMNSLRAEDTAVYYCAR (SEQ ID NO: 169)
RFTFSADNAKNSLYMQMNSLRAEDTAVYYCAR (SEQ ID NO: 170)
RFTFSADNAKNSLYLQLNSLRAEDTAVYYCAR (SEQ ID NO: 171)
RFTFSRDTAKNSAYLQMNSLRAEDTAVYYCAR (SEQ ID NO: 172)
RFTFSRDTAKNSLYMQMNSLRAEDTAVYYCAR (SEQ ID NO: 173)
RFTFSRDTAKNSLYLQLNSLRAEDTAVYYCAR (SEQ ID NO: 174)
RFTFSRDNAKNSAYMQMNSLRAEDTAVYYCAR (SEQ ID NO: 175)
RFTFSRDNAKNSAYLQLNSLRAEDTAVYYCAR (SEQ ID NO: 176)

TABLE 5-continued

Amino Acid Sequences derived from Murine 175A Antibody.

RFTFSRDNAKNSLYMQLNSLRAEDTAVYYCAR (SEQ ID NO: 177)
RFTISADTAKNSA**YLQMNSLRAEDTAVYYCAR (SEQ ID NO: 178)
RFTISADTAKNSLYMQLNSLRAEDTAVYYCAR (SEQ ID NO: 179)
RFTISADTAKNSLYLQLNSLRAEDTAVYYCAR (SEQ ID NO: 180)
RFTISADNAKNSAYMQLNSLRAEDTAVYYCAR (SEQ ID NO: 181)
RFTISADNAKNSAYLQLNSLRAEDTAVYYCAR (SEQ ID NO: 182)
RFTISADNAKNSLYMQLNSLRAEDTAVYYCAR (SEQ ID NO: 183)
RFTISRDTAKNSAYMQMNSLRAEDTAVYYCAR (SEQ ID NO: 184)
RFTISRDTAKNSAYLQMNSLRAEDTAVYYCAR (SEQ ID NO: 185)
RFTISRDTAKNSLYMQLNSLRAEDTAVYYCAR (SEQ ID NO: 186)
RFTISRDNAKNSAYMQLNSLRAEDTAVYYCAR (SEQ ID NO: 187)
RATFSADTAKNSLYLQMNSLRAEDTAVYYCAR (SEQ ID NO: 188)
RATFSADNAKNSAYLQMNSLRAEDTAVYYCAR (SEQ ID NO: 189)
RATFSADTAKNSLYMQLNSLRAEDTAVYYCAR (SEQ ID NO: 190)
RATFSADNAKNSLYLQLNSLRAEDTAVYYCAR (SEQ ID NO: 191)
RATFSRDTAKNSAYLQMNSLRAEDTAVYYCAR (SEQ ID NO: 192)
RATFSRDTAKNSLYMQMNSLRAEDTAVYYCAR (SEQ ID NO: 193)
RATFSRDTAKNSLYLQLNSLRAEDTAVYYCAR (SEQ ID NO: 194)
RATFSRDNAKNSAYMQMNSLRAEDTAVYYCAR (SEQ ID NO: 195)
RATFSRDNAKNSAYLQLNSLRAEDTAVYYCAR (SEQ ID NO: 196)
RATFSRDNAKNSLYMQLNSLRAEDTAVYYCAR (SEQ ID NO: 197)
RATISADTAKNA**LYLQMNSLRAEDTAVYYCAR (SEQ ID NO: 198)
RATISADTAKNSLYMQ**MNSLRAEDTAVYYCAR (SEQ ID NO: 199)
RATISADTAKNSLYLQLNSLRAEDTAVYYCAR (SEQ ID NO: 200)
RATISADNAKNSA**YMQMNSLRAEDTAVYYCAR (SEQ ID NO: 201)
RATISADNAKNSA**YLQMNSLRAEDTAVYYCAR (SEQ ID NO: 202)
RATISADNAKNSLYMQ**LNSLRAEDTAVYYCAR (SEQ ID NO: 203)
RATISRDTAKNSAYMQMNSLRAEDTAVYYCAR (SEQ ID NO: 204)
RATISRDTAKNSAYLQMNSLRAEDTAVYYCAR (SEQ ID NO: 205)
RATISRDTAKNSLYMQLNSLRAEDTAVYYCAR (SEQ ID NO: 206)
RATISRDNAKNSAYMQMNSLRAEDTAVYYCAR (SEQ ID NO: 207)
RFTFSADTAKNSA**YLQMNSLRAEDTAVYYCAR (SEQ ID NO: 208)
RFTFSADTAKNSLYMQ**MNSLRAEDTAVYYCAR (SEQ ID NO: 209)
RFTFSADTAKNSLYLQLNSLRAEDTAVYYCAR (SEQ ID NO: 210)
RFTFSADNAKNSA**YMQMNSLRAEDTAVYYCAR (SEQ ID NO: 211)
RFTFSADNAKNSA**YLQMNSLRAEDTAVYYCAR (SEQ ID NO: 212)
RFTFSADNAKNSLYMQ**LNSLRAEDTAVYYCAR (SEQ ID NO: 213)
RFTFSRDTAKNSAYMQMNSLRAEDTAVYYCAR (SEQ ID NO: 214)
RFTFSRDTAKNSAYLQMNSLRAEDTAVYYCAR (SEQ ID NO: 215)
RFTFSRDTAKNSLYMQLNSLRAEDTAVYYCAR (SEQ ID NO: 216)
RFTFSRDNAKNSAYMQLNSLRAEDTAVYYCAR (SEQ ID NO: 217)
RFTISADTAKNSA**YMQMNSLRAEDTAVYYCAR (SEQ ID NO: 218)
RFTISADTAKNSLYLQLNSLRAEDTAVYYCAR (SEQ ID NO: 219)
RFTISADTAKNSLYMQ**LNSLRAEDTAVYYCAR (SEQ ID NO: 220)
RFTISADNAKNSLYMQ**LNSLRAEDTAVYYCAR (SEQ ID NO: 221)
RFTISRDTAKNSAYMQLNSLRAEDTAVYYCAR (SEQ ID NO: 222)
RATFSADTAKNSAYLQMNSLRAEDTAVYYCAR (SEQ ID NO: 223)
RATFSADTAKNSLYMQMNSLRAEDTAVYYCAR (SEQ ID NO: 224)
RATFSADTAKNSLYLQ**LNSLRAEDTAVYYCAR (SEQ ID NO: 225)
RATFSADNAKNSAYMQMNSLRAEDTAVYYCAR (SEQ ID NO: 226)
RATFSADNAKNSAYLQ**LNSLRAEDTAVYYCAR (SEQ ID NO: 227)
RATFSADNAKNSLYMQLNSLRAEDTAVYYCAR (SEQ ID NO: 228)
RATFSRDTAKNSAYMQMNSLRAEDTAVYYCAR (SEQ ID NO: 229)
RATFSRDTAKNSAYLQMNSLRAEDTAVYYCAR (SEQ ID NO: 230)
RATFSRDTAKNSLYMQLNSLRAEDTAVYYCAR (SEQ ID NO: 231)
RATFSRDNAKNSAYMQMNSLRAEDTAVYYCAR (SEQ ID NO: 232)
RATISADTAKNALYMQ**MNSLRAEDTAVYYCAR (SEQ ID NO: 233)
RATISADTAKNALYLQLNSLRAEDTAVYYCAR (SEQ ID NO: 234)
RATISADTAKNSLYMQ**LNSLRAEDTAVYYCAR (SEQ ID NO: 235)
RATISADNAKNSAYMQ**LNSLRAEDTAVYYCAR (SEQ ID NO: 236)
RATISRDTAKNSAYMQLNSLRAEDTAVYYCAR (SEQ ID NO: 237)
RFTFSADTAKNSAYMQ**MNSLRAEDTAVYYCAR (SEQ ID NO: 238)
RFTFSADTAKNSAYLQLNSLRAEDTAVYYCAR (SEQ ID NO: 239)
RFTFSADTAKNSLYMQ**LNSLRAEDTAVYYCAR (SEQ ID NO: 240)
RFTFSADNAKNSAYMQ**LNSLRAEDTAVYYCAR (SEQ ID NO: 241)
RFTFSRDTAKNSAYMQLNSLRAEDTAVYYCAR (SEQ ID NO: 242)
RFTISADTAKNSAYMQ**LNSLRAEDTAVYYCAR (SEQ ID NO: 243)
RATFSADTAKNSAYMQLNSLRAEDTAVYYCAR (SEQ ID NO: 244)
RATFSADTAKNSAYLQ**LNSLRAEDTAVYYCAR (SEQ ID NO: 245)
RATFSADNAKNSAYMQLNSLRAEDTAVYYCAR (SEQ ID NO: 246)
RATFSRDTAKNSAYMQLNSLRAEDTAVYYCAR (SEQ ID NO: 247)
RATFSRDNAKNSAYMQLNSLRAEDTAVYYCAR (SEQ ID NO: 248)
RATISADTAKNALYMQ**LNSLRAEDTAVYYCAR (SEQ ID NO: 249)
RFTFSADTAKNSAYMQ**LNSLRAEDTAVYYCAR (SEQ ID NO: 250)
RATFSADTAKNSAYMQLNSLRAEDTAVYYCAR (SEQ ID NO: 251)

175A-huVH3b VH CDR3
WLLYYYAMDY (SEQ ID NO: 38)

175A-huVH3b VH FR4
WGQGTLVTVSS (SEQ ID NO: 54)

175A HUMANIZED ANTIBODY SEQUENCE: LIGHT CHAIN
175A-huVK2 Variable Region
DIVMTQSPLSLPVTPGEPASISCRSSQSIVHSNGNTYLEWYLQKPGQSPQ
LLIYKLSNRFSGVPDRFSGSGSGTDFTLKISRVEAEDVGVYYCFQGSHFP
YTFGQGTKLEIK (SEQ ID NO: 28)

175A-huVK2 VL FR1
DIVMTQSPLSLPVTPGEPASISC (SEQ ID NO: 75)
DVVMTQSPLSLPVTPGEPASISC (SEQ ID NO: 252)

175A-huVK2 VL CDR1
RSSQSIVHSNGNTYLE (SEQ ID NO: 45)
RSSQSIVHSQGNTYLE (SEQ ID NO: 253)
RSSQSIVHSSGNTYLE (SEQ ID NO: 254)
RSSQSIVHSAGNTYLE (SEQ ID NO: 255)
RSSQSIVHSNGQTYLE (SEQ ID NO: 256)
RSSQSIVHSNGSTYLE (SEQ ID NO: 257)
RSSQSIVHSNGATYLE (SEQ ID NO: 258)
RSSQSIVHSNGDTYLE (SEQ ID NO: 259)
RSSQSIVHSQGQTYLE (SEQ ID NO: 260)
RSSQSIVHSQGSTYLE (SEQ ID NO: 261)
RSSQSIVHSQGATYLE (SEQ ID NO: 262)
RSSQSIVHSQGDTYLE (SEQ ID NO: 263)
RSSQSIVHSSGQTYLE (SEQ ID NO: 264)
RSSQSIVHSSGSTYLE (SEQ ID NO: 265)
RSSQSIVHSSGATYLE (SEQ ID NO: 266)
RSSQSIVHSSGDTYLE (SEQ ID NO: 267)
RSSQSIVHSAGQTYLE (SEQ ID NO: 268)
RSSQSIVHSAGSTYLE (SEQ ID NO: 269)
RSSQSIVHSAGATYLE (SEQ ID NO: 270)
RSSQSIVHSAGDTYLE (SEQ ID NO: 271)

175A-huVK2 VL FR2
WYLQKPGQSPQLLIY (SEQ ID NO: 76)

175A-huVK2 VL CDR2
KLSNRFS (SEQ ID NO: 46)
KLSQRFS (SEQ ID NO: 272)
KLSSRFS (SEQ ID NO: 273)
KLSARFS (SEQ ID NO: 274)
KLSDRFS (SEQ ID NO: 275)

175A-huVK2 VL FR3
GVPDRFSGSGSGTDFTLKISRVEAEDVGVYYC (SEQ ID NO: 77)
GVPDRFSGSGSGTDFTLKISRVEAEDLGVYYC (SEQ ID NO: 276)

175A-huVK2 VL CDR3
FQGSHFPYT (SEQ ID NO: 47)

175A-huVK2 VL FR4
FGQGTKLEIK (SEQ ID NO: 78)

175A-huVK1 Variable Region
DIQMTQSPSSLSASVGDRVTITCRSSQSIVHSNGNTYLEWYQQKPGKAPK
LLIYKLSNRFSGVPSRFSGSGSGTDFTLTISSLQPEDFATYYCFQGSHFP
YTFGQGTKLEIK (SEQ IDNO: 29)

175A-huVK1 VL FR1
DIQMTQSPSSLSASVGDRVTITC (SEQ ID NO: 79)
DVQMTQSPSSLSASVGDRVTITC (SEQ ID NO: 277)
DIQMTQSPSSLSVSVGDRVTITC (SEQ ID NO: 278)
DIQMTQSPSSLSASVGDRATITC (SEQ ID NO: 279)
DVQMTQSPSSLSVSVGDRVTITC (SEQ ID NO: 280)
DVQMTQSPSSLSASVGDRATITC (SEQ ID NO: 281)
DIQMTQSPSSLSVSVGDRATITC (SEQ ID NO: 282)
DVQMTQSPSSLSVSVGDRATITC (SEQ ID NO: 283)

175A-huVK1 VL CDR1
RSSQSIVHSNGNTYLE (SEQ ID NO: 45)
RSSQSIVHSQGNTYLE (SEQ ID NO: 253)

TABLE 5-continued

Amino Acid Sequences derived from Murine 175A Antibody.

RSSQSIVHSSGNTYLE (SEQ ID NO: 254)
RSSQSIVHSAGNTYLE (SEQ ID NO: 255)
RSSQSIVHSNGQTYLE (SEQ ID NO: 256)
RSSQSIVHSNGSTYLE (SEQ ID NO: 257)
RSSQSIVHSNGATYLE (SEQ ID NO: 258)
RSSQSIVHSNGDTYLE (SEQ ID NO: 259)
RSSQSIVHSQGQTYLE (SEQ ID NO: 260)
RSSQSIVHSQGSTYLE (SEQ ID NO: 261)
RSSQSIVHSQGATYLE (SEQ ID NO: 262)
RSSQSIVHSQGDTYLE (SEQ ID NO: 263)
RSSQSIVHSSGQTYLE (SEQ ID NO: 264)
RSSQSIVHSSGSTYLE (SEQ ID NO: 265)
RSSQSIVHSSGATYLE (SEQ ID NO: 266)
RSSQSIVHSSGDTYLE (SEQ ID NO: 267)
RSSQSIVHSAGQTYLE (SEQ ID NO: 268)
RSSQSIVHSAGSTYLE (SEQ ID NO: 269)
RSSQSIVHSAGATYLE (SEQ ID NO: 270)
RSSQSIVHSAGDTYLE (SEQ ID NO: 271)

175A-huVK1 VL FR2
WYQQKPGKAPKLLIY (SEQ ID NO: 80)
WYQQKPGKSPKLLIY (SEQ ID NO: 284)

175A-huVK1 VL CDR2
KLSNRFS (SEQ ID NO: 46)
KLSQRFS (SEQ ID NO: 272)
KLSSRFS (SEQ ID NO: 273)
KLSARFS (SEQ ID NO: 274)
KLSDRFS (SEQ ID NO: 275)

175A-huVK1 VL FR3
GVPSRFSGSGSGTDFTLTISSLQPEDFATYYC (SEQ ID NO: 81)
GVPSRFSGSGSGTDFTLTISSVQPEDFATYYC (SEQ ID NO: 285)
GVPSRFSGSGSGTDFTLTISSLQPEDLATYYC (SEQ ID NO: 286)
GVPSRFSGSGSGTDFTLTISSLQPEDFG**TYYC (SEQ ID NO: 287)
GVPSRFSGSGSGTDFTLTISSVQPEDLATYYC (SEQ ID NO: 288)
GVPSRFSGSGSGTDFTLTISSVQPEDFGTYYC (SEQ ID NO: 289)
GVPSRFSGSGSGTDFTLTISSLQPEDLGTYYC (SEQ ID NO: 290)
GVPSRFSGSGSGTDFTLTISSVQPEDLGTYYC (SEQ ID NO: 291)

175A-huVK1 VL CDR3
FQGSHFPYT (SEQ ID NO: 47)

175A-huVK1 VL FR4
FGQGTKLEIK (SEQ ID NO: 78)

*Amino acid position numbering as in Kabat.

TABLE 6

Amino Acid Sequences derived from Murine 76E1 Antibody.

76E1 HUMANIZED ANTIBODY SEQUENCE: HEAVY CHAIN
76E1-huVH1a Variable Region
QVQLVQSGAEVKKPGASVKVSCKASGYSFTGYNMNWVRQAPGQGLEWMGN
IDPYYDYTSYNLKFKDRVTMTTDTSTSTAYMELRSLRSDDTAVYYCARST
MITPFDYWGQGTLVTVSS (SEQ ID NO: 12)

76E1-huVH1a VH FR1
QVQLVQSGAEVKKPGASVKVSCKAS (SEQ ID NO: 51)
QVQLVQSGAEVKKPGASVKISCKAS (SEQ ID NO: 105)

76E1-huVH1a VH CDR1
GYSFTGYNMN (SEQ ID NO: 30)
GYSFTGYQMN (SEQ ID NO: 59)
GYSFTGYSMN (SEQ ID NO: 60)
GYSFTGYDMN (SEQ ID NO: 61)
GYSFTGYAMN (SEQ ID NO: 62)

76E1-huVH1a VH FR2
WVRQAPGQGLEWMG (SEQ ID NO: 52)
WVRQAPGQSLEWMG (SEQ ID NO: 63)
WVRQAPGQGLEWIG (SEQ ID NO: 106)
WVRQAPGQSLEWIG (SEQ ID NO: 64)

TABLE 6-continued

Amino Acid Sequences derived from Murine 76E1 Antibody.

76E1-huVH1a VH CDR2
NIDPYYDYTSYNLKFKD (SEQ ID NO: 31)
NIEPYYDYTSYNLKFKD (SEQ ID NO: 65)
NISPYYDYTSYNLKFKD (SEQ ID NO: 66)
NIAPYYDYTSYNLKFKD (SEQ ID NO: 67)
NIDPYYDYTSYQLKFKD (SEQ ID NO: 68)
NIDPYYDYTSYSLKFKD (SEQ ID NO: 69)
NIDPYYDYTSYDLKFKD (SEQ ID NO: 70)
NIDPYYDYTSYALKFKD (SEQ ID NO: 71)
NIEPYYDYTSYQLKFKD (SEQ ID NO: 72)
NIEPYYDYTSYSLKFKD (SEQ ID NO: 73)
NIEPYYDYTSYDLKFKD (SEQ ID NO: 74)
NIEPYYDYTSYALKFKD (SEQ ID NO: 83)
NISPYYDYTSYQLKFKD (SEQ ID NO: 84)
NISPYYDYTSYSLKFKD (SEQ ID NO: 85)
NISPYYDYTSYDLKFKD (SEQ ID NO: 86)
NISPYYDYTSYALKFKD (SEQ ID NO: 87)
NIAPYYDYTSYQLKFKD (SEQ ID NO: 88)
NIAPYYDYTSYSLKFKD (SEQ ID NO: 89)
NIAPYYDYTSYDLKFKD (SEQ ID NO: 90)
NIAPYYDYTSYALKFKD (SEQ ID NO: 95)

76E1-huVH1a VH FR3
RVTMTTDTSTSTAYMELRSLRSDDTAVYYCAR (SEQ ID NO: 53)
RATMTTDTSTSTAYMELRSLRSDDTAVYYCAR (SEQ ID NO: 107)
RVTLTTDTSTSTAYMELRSLRSDDTAVYYCAR (SEQ ID NO: 96)
RVTMTVDTSTSTAYMELRSLRSDDTAVYYCAR (SEQ ID NO: 97)
RVTMTTDKSTSTAYMELRSLRSDDTAVYYCAR (SEQ ID NO: 98)
RVTMTTDTSTSTAYMELRSLRSDDTAVYYCAT (SEQ ID NO: 292)
RATLTTDTSTSTAYMELRSLRSDDTAVYYCAR (SEQ ID NO: 293)
RATMTVDTSTSTAYMELRSLRSDDTAVYYCAR (SEQ ID NO: 294)
RATMTTDKSTSTAYMELRSLRSDDTAVYYCAR (SEQ ID NO: 295)
RATMTTDTSTSTAYMELRSLRSDDTAVYYCAT (SEQ ID NO: 296)
RVTLTVDTSTSTAYMELRSLRSDDTAVYYCAR (SEQ ID NO: 297)
RVTLTTDKSTSTAYMELRSLRSDDTAVYYCAR (SEQ ID NO: 298)
RVTLTTDTSTSTAYMELRSLRSDDTAVYYCAT (SEQ ID NO: 299)
RVTMTVDKSTSTAYMELRSLRSDDTAVYYCAR (SEQ ID NO: 300)
RVTMTVDTSTSTAYMELRSLRSDDTAVYYCAT (SEQ ID NO: 301)
RVTMTTDKSTSTAYMELRSLRSDDTAVYYCAT (SEQ ID NO: 302)
RATLTVDTSTSTAYMELRSLRSDDTAVYYCAR (SEQ ID NO: 303)
RATLTTDKSTSTAYMELRSLRSDDTAVYYCAR (SEQ ID NO: 304)
RATLTTDTSTSTAYMELRSLRSDDTAVYYCAT (SEQ ID NO: 305)
RATMTVDKSTSTAYMELRSLRSDDTAVYYCAR (SEQ ID NO: 306)
RATMTVDTSTSTAYMELRSLRSDDTAVYYCAT (SEQ ID NO: 307)
RATMTTDKSTSTAYMELRSLRSDDTAVYYCAT (SEQ ID NO: 308)
RVTLTVDKSTSTAYMELRSLRSDDTAVYYCAR (SEQ ID NO: 309)
RVTLTVDTSTSTAYMELRSLRSDDTAVYYCAT (SEQ ID NO: 310)
RVTLTTDKSTSTAYMELRSLRSDDTAVYYCAT (SEQ ID NO: 311)
RVTMTVDKSTSTAYMELRSLRSDDTAVYYCAT (SEQ ID NO: 312)
RATLTVDKSTSTAYMELRSLRSDDTAVYYCAR (SEQ ID NO: 313)
RATLTVDTSTSTAYMELRSLRSDDTAVYYCAT (SEQ ID NO: 314)
RATLTTDKSTSTAYMELRSLRSDDTAVYYCAT (SEQ ID NO: 315)
RATMTVDKSTSTAYMELRSLRSDDTAVYYCAT (SEQ ID NO: 316)
RVTLTVDKSTSTAYMELRSLRSDDTAVYYCAT (SEQ ID NO: 317)
RATLTVDKSTSTAYMELRSLRSDDTAVYYCAT (SEQ ID NO: 318)

76E1-huVH1a VH CDR3
STMITPFDY (SEQ ID NO: 32)
STLITPFDY (SEQ ID NO: 319)

76E1-huVH1a VH FR4
WGQGTLVTVSS (SEQ ID NO: 54)
WGQGTLLTVSS (SEQ ID NO: 320)

76E1-huVH1b Variable Region
QVQLVQSGAEVKKPGASVKVSCKASGYSFTGYNMNWVRQAPGQGLEWMGN
IDPYYDYTSYAQKLQGRVTMTTDTSTSTAYMELRSLRSDDTAVYYCARST
MITPFDYWGQGTLVTVSS (SEQ ID NO: 13)

76E1-huVH1b VH FR1
QVQLVQSGAEVKKPGASVKVSCKAS (SEQ ID NO: 51)
QVQLVQSGAEVKKPGASVKISCKAS (SEQ ID NO: 105)

76E1-huVH1b VH CDR1
GYSFTGYNMN (SEQ ID NO: 30)
GYSFTGYQMN (SEQ ID NO: 59)

TABLE 6-continued

Amino Acid Sequences derived from Murine 76E1 Antibody.

GYSFTGYSMN (SEQ ID NO: 60)
GYSFTGYDMN (SEQ ID NO: 61)
GYSFTGYAMN (SEQ ID NO: 62)

76E1-huVH1b VH FR2
WVRQAPGQGLEWMG (SEQ ID NO: 52)
WVRQAPGQSLEWMG (SEQ ID NO: 63)
WVRQAPGQGLEWIG (SEQ ID NO: 106)
WVRQAPGQSLEWIG (SEQ ID NO: 64)

76E1-huVH1b VH CDR2*
NIDPYYDYTSYAQKLQG (SEQ ID NO: 321)
NIDPYYDYTSYAQKFQG (SEQ ID NO: 322)

76E1-huVH1b VH FR3
RVTMTTDTSTSTAYMELRSLRSDDTAVYYCAR (SEQ ID NO: 53)
RATMTTDTSTSTAYMELRSLRSDDTAVYYCAR (SEQ ID NO: 107)
RVTLTTDTSTSTAYMELRSLRSDDTAVYYCAR (SEQ ID NO: 96)
RVTMTVDTSTSTAYMELRSLRSDDTAVYYCAR (SEQ ID NO: 97)
RVTMTTDKSTSTAYMELRSLRSDDTAVYYCAR (SEQ ID NO: 98)
RVTMTTDTSTSTAYMELRSLRSDDTAVYYCAT (SEQ ID NO: 292)
RATLTTDTSTSTAYMELRSLRSDDTAVYYCAR (SEQ ID NO: 293)
RATMTVDTSTSTAYMELRSLRSDDTAVYYCAR (SEQ ID NO: 294)
RATMTTDKSTSTAYMELRSLRSDDTAVYYCAR (SEQ ID NO: 295)
RATMTTDTSTSTAYMELRSLRSDDTAVYYCAT (SEQ ID NO: 296)
RVTLTVDTSTSTAYMELRSLRSDDTAVYYCAR (SEQ ID NO: 297)
RVTLTTDKSTSTAYMELRSLRSDDTAVYYCAR (SEQ ID NO: 298)
RVTLTTDTSTSTAYMELRSLRSDDTAVYYCAT (SEQ ID NO: 299)
RVTMTVDKSTSTAYMELRSLRSDDTAVYYCAR (SEQ ID NO: 300)
RVTMTVDTSTSTAYMELRSLRSDDTAVYYCAT (SEQ ID NO: 301)
RVTMTTDKSTSTAYMELRSLRSDDTAVYYCAT (SEQ ID NO: 302)
RATLTVDTSTSTAYMELRSLRSDDTAVYYCAR (SEQ ID NO: 303)
RATLTTDKSTSTAYMELRSLRSDDTAVYYCAR (SEQ ID NO: 304)
RATLTTDTSTSTAYMELRSLRSDDTAVYYCAT (SEQ ID NO: 305)
RATMTVDKSTSTAYMELRSLRSDDTAVYYCAR (SEQ ID NO: 306)
RATMTVDTSTSTAYMELRSLRSDDTAVYYCAT (SEQ ID NO: 307)
RATMTTDKSTSTAYMELRSLRSDDTAVYYCAT (SEQ ID NO: 308)
RVTLTVDKSTSTAYMELRSLRSDDTAVYYCAR (SEQ ID NO: 309)
RVTLTVDTSTSTAYMELRSLRSDDTAVYYCAT (SEQ ID NO: 310)
RVTLTTDKSTSTAYMELRSLRSDDTAVYYCAT (SEQ ID NO: 311)
RVTMTVDKSTSTAYMELRSLRSDDTAVYYCAT (SEQ ID NO: 312)
RATLTVDKSTSTAYMELRSLRSDDTAVYYCAR (SEQ ID NO: 313)
RATLTVDTSTSTAYMELRSLRSDDTAVYYCAT (SEQ ID NO: 314)
RATLTTDKSTSTAYMELRSLRSDDTAVYYCAT (SEQ ID NO: 315)
RATMTVDKSTSTAYMELRSLRSDDTAVYYCAT (SEQ ID NO: 316)
RVTLTVDKSTSTAYMELRSLRSDDTAVYYCAT (SEQ ID NO: 317)
RATLTVDKSTSTAYMELRSLRSDDTAVYYCAT (SEQ ID NO: 318)

76E1-huVH1b VH CDR3
STMITPFDY (SEQ ID NO: 32)
STLITPFDY (SEQ ID NO: 319)

76E1-huVH1b VH FR4
WGQGTLVTVSS (SEQ ID NO: 54)
WGQGTLLTVSS (SEQ ID NO: 320)

76E1-huVH3a Variable Region
EVQLVESGGGLVQPGGSLRLSCAASGYSFTGYNMNWVRQAPGKGLEWVSN
IDPYYDYTSYNLKFKDRFTISRDNAKNSLYLQMNSLRAEDTAVYYCARST
MITPFDYWGQGTLVTVSS (SEQ ID NO: 14)

76E1-huVH3a VH FR1
EVQLVESGGGLVQPGGSLRLSCAAS (SEQ ID NO: 55)
EVQLVQSGGGLVQPGGSLRLSCAAS (SEQ ID NO: 115)
EVQLVESGGGLVQPGGSVRLSCAAS (SEQ ID NO: 116)
EVQLVESGGGLVQPGGSLRISCAAS (SEQ ID NO: 117)
EVQLVQSGGGLVQPGGSVRLSCAAS (SEQ ID NO: 118)
EVQLVESGGGLVQPGGSVRISCAAS (SEQ ID NO: 119)
EVQLVQSGGGLVQPGGSLRISCAAS (SEQ ID NO: 120)
EVQLVQSGGGLVQPGGSVRISCAAS (SEQ ID NO: 121)

76E1-huVH3a VH CDR1
GYSFTGYNMN (SEQ ID NO: 30)
GYSFTGYQMN (SEQ ID NO: 59)
GYSFTGYSMN (SEQ ID NO: 60)
GYSFTGYDMN (SEQ ID NO: 61)
GYSFTGYAMN (SEQ ID NO: 62)

TABLE 6-continued

Amino Acid Sequences derived from Murine 76E1 Antibody.

76E1-huVH3a VH FR2
WVRQAPGKGLEWVS (SEQ ID NO: 56)
WVRQAPGKSLEWVS (SEQ ID NO: 323)
WVRQAPGKGLEWIS (SEQ ID NO: 122)
WVRQAPGKGLEWVG (SEQ ID NO: 123)
WVRQAPGKSLEWIS (SEQ ID NO: 324)
WVRQAPGKSLEWVG (SEQ ID NO: 325)
WVRQAPGKGLEWIG (SEQ ID NO: 124)
WVRQAPGKSLEWIG (SEQ ID NO: 326)

76E1-huVH3a VH CDR2
NIDPYYDTSYNLKFKD (SEQ ID NO: 31)
NIEPYYDTSYNLKFKD (SEQ ID NO: 65)
NISPYYDTSYNLKFKD (SEQ ID NO: 66)
NIAPYYDTSYNLKFKD (SEQ ID NO: 67)
NIDPYYDTSYQLKFKD (SEQ ID NO: 68)
NIDPYYDTSYSLKFKD (SEQ ID NO: 69)
NIDPYYDTSYDLKFKD (SEQ ID NO: 70)
NIDPYYDTSYALKFKD (SEQ ID NO: 71)
NIEPYYDTSYQLKFKD (SEQ ID NO: 72)
NIEPYYDTSYSLKFKD (SEQ ID NO: 73)
NIEPYYDTSYDLKFKD (SEQ ID NO: 74)
NIEPYYDTSYALKFKD (SEQ ID NO: 83)
NISPYYDTSYQLKFKD (SEQ ID NO: 84)
NISPYYDTSYSLKFKD (SEQ ID NO: 85)
NISPYYDTSYDLKFKD (SEQ ID NO: 86)
NISPYYDTSYALKFKD (SEQ ID NO: 87)
NIAPYYDTSYQLKFKD (SEQ ID NO: 88)
NIAPYYDTSYSLKFKD (SEQ ID NO: 89)
NIAPYYDTSYDLKFKD (SEQ ID NO: 90)
NIAPYYDTSYALKFKD (SEQ ID NO: 95)

76E1-huVH3a VH FR3
RFTISRDNAKNSLYLQMNSLRAEDTAVYYCAR (SEQ ID NO: 57)
RATISRDNAKNSLYLQMNSLRAEDTAVYYCAR (SEQ ID NO: 327)
RFTLSRDNAKNSLYLQMNSLRAEDTAVYYCAR (SEQ ID NO: 328)
RFTISVDNAKNSLYLQMNSLRAEDTAVYYCAR (SEQ ID NO: 329)
RFTISRDKAKNSLYLQMNSLRAEDTAVYYCAR (SEQ ID NO: 330)
RFTISRDNAKSSLYLQMNSLRAEDTAVYYCAR (SEQ ID NO: 331)
RFTISRDNAKNSAYLQMNSLRAEDTAVYYCAR (SEQ ID NO: 332)
RFTISRDNAKNSLYMQMNSLRAEDTAVYYCAR (SEQ ID NO: 333)
RFTISRDNAKNSLYLQLNSLRAEDTAVYYCAR (SEQ ID NO: 334)
RFTISRDNAKNSLYLQMNSLRAEDTAVYYCAT (SEQ ID NO: 335)
RATLSRDNAKNSLYLQMNSLRAEDTAVYYCAR (SEQ ID NO: 336)
RATISVDNAKNSLYLQMNSLRAEDTAVYYCAR (SEQ ID NO: 337)
RATISRDKAKNSLYLQMNSLRAEDTAVYYCAR (SEQ ID NO: 338)
RATISRDNAKSSLYLQMNSLRAEDTAVYYCAR (SEQ ID NO: 339)
RATISRDNAKNSAYLQMNSLRAEDTAVYYCAR (SEQ ID NO: 340)
RATISRDNAKNSLYMQMNSLRAEDTAVYYCAR (SEQ ID NO: 341)
RATISRDNAKNSLYLQLNSLRAEDTAVYYCAR (SEQ ID NO: 342)
RATISRDNAKNSLYLQMNSLRAEDTAVYYCAT (SEQ ID NO: 343)
RFTLSVDNAKNSLYLQMNSLRAEDTAVYYCAR (SEQ ID NO: 344)
RFTLSRDKAKNSLYLQMNSLRAEDTAVYYCAR (SEQ ID NO: 345)
RFTLSRDNAKSSLYLQMNSLRAEDTAVYYCAR (SEQ ID NO: 346)
RFTLSRDNAKNSAYLQMNSLRAEDTAVYYCAR (SEQ ID NO: 347)
RFTLSRDNAKNSLYMQMNSLRAEDTAVYYCAR (SEQ ID NO: 348)
RFTLSRDNAKNSLYLQLNSLRAEDTAVYYCAR (SEQ ID NO: 349)
RFTLSRDNAKNSLYLQMNSLRAEDTAVYYCAT (SEQ ID NO: 350)
RFTISVDKAKNSLYLQMNSLRAEDTAVYYCAR (SEQ ID NO: 351)
RFTISVDNAKSSLYLQMNSLRAEDTAVYYCAR (SEQ ID NO: 352)
RFTISVDNAKNSAYLQMNSLRAEDTAVYYCAR (SEQ ID NO: 353)
RFTISVDNAKNSLYMQMNSLRAEDTAVYYCAR (SEQ ID NO: 354)
RFTISVDNAKNSLYLQLNSLRAEDTAVYYCAR (SEQ ID NO: 355)
RFTISVDNAKNSLYLQMNSLRAEDTAVYYCAT (SEQ ID NO: 356)
RFTISRDKAKSSLYLQMNSLRAEDTAVYYCAR (SEQ ID NO: 357)
RFTISRDKAKNSAYLQMNSLRAEDTAVYYCAR (SEQ ID NO: 358)
RFTISRDKAKNSLYMQMNSLRAEDTAVYYCAR (SEQ ID NO: 359)
RFTISRDKAKNSLYLQLNSLRAEDTAVYYCAR (SEQ ID NO: 360)
RFTISRDKAKNSLYLQMNSLRAEDTAVYYCAT (SEQ ID NO: 361)
RFTISRDNAKSSAYLQMNSLRAEDTAVYYCAR (SEQ ID NO: 362)
RFTISRDNAKSSLYMQMNSLRAEDTAVYYCAR (SEQ ID NO: 363)
RFTISRDNAKSSLYLQLNSLRAEDTAVYYCAR (SEQ ID NO: 364)
RFTISRDNAKSSLYLQMNSLRAEDTAVYYCAT (SEQ ID NO: 365)
RFTISRDNAKNSAYMQMNSLRAEDTAVYYCAR (SEQ ID NO: 366)
RFTISRDNAKNSAYLQLNSLRAEDTAVYYCAR (SEQ ID NO: 367)
RFTISRDNAKNSAYLQMNSLRAEDTAVYYCAT (SEQ ID NO: 368)

TABLE 6-continued

Amino Acid Sequences derived from Murine 76E1 Antibody.

RFTISRDNAKNSLYMQLNSLRAEDTAVYYCAR (SEQ ID NO: 369)
RFTISRDNAKNSLYMQMNSLRAEDTAVYYCAT (SEQ ID NO: 370)
RFTISRDNAKNSLYLQLNSLRAEDTAVYYCAT (SEQ ID NO: 371)
RATLSVDNAKNSLYLQMNSLRAEDTAVYYCAR (SEQ ID NO: 372)
RATLSRDKAKNSLYLQMNSLRAEDTAVYYCAR (SEQ ID NO: 373)
RATLSRDNAKSSLYLQMNSLRAEDTAVYYCAR (SEQ ID NO: 374)
RATLSRDNAKNSAYLQMNSLRAEDTAVYYCAR (SEQ ID NO: 375)
RATLSRDNAKNSLYMQMNSLRAEDTAVYYCAR (SEQ ID NO: 376)
RATLSRDNAKNSLYLQLNSLRAEDTAVYYCAR (SEQ ID NO: 377)
RATLSRDNAKNSLYLQMNSLRAEDTAVYYCAT (SEQ ID NO: 378)
RATISVDKAKNSLYLQMNSLRAEDTAVYYCAR (SEQ ID NO: 379)
RATISVDNAKSSLYLQMNSLRAEDTAVYYCAR (SEQ ID NO: 380)
RATISVDNAKNSAYLQMNSLRAEDTAVYYCAR (SEQ ID NO: 381)
RATISVDNAKNSLYMQMNSLRAEDTAVYYCAR (SEQ ID NO: 382)
RATISVDNAKNSLYLQLNSLRAEDTAVYYCAR (SEQ ID NO: 383)
RATISVDNAKNSLYLQMNSLRAEDTAVYYCAT (SEQ ID NO: 384)
RATISRDKAKSSLYLQMNSLRAEDTAVYYCAR (SEQ ID NO: 385)
RATISRDKAKNSAYLQMNSLRAEDTAVYYCAR (SEQ ID NO: 386)
RATISRDKAKNSLYMQMNSLRAEDTAVYYCAR (SEQ ID NO: 387)
RATISRDKAKNSLYLQLNSLRAEDTAVYYCAR (SEQ ID NO: 388)
RATISRDKAKNSLYLQMNSLRAEDTAVYYCAT (SEQ ID NO: 389)
RATISRDNAKSSAYLQMNSLRAEDTAVYYCAR (SEQ ID NO: 390)
RATISRDNAKSSLYMQMNSLRAEDTAVYYCAR (SEQ ID NO: 391)
RATISRDNAKSSLYLQLNSLRAEDTAVYYCAR (SEQ ID NO: 392)
RATISRDNAKSSLYLQMNSLRAEDTAVYYCAT (SEQ ID NO: 393)
RATISRDNAKNSAYMQMNSLRAEDTAVYYCAR (SEQ ID NO: 394)
RATISRDNAKNSAYLQLNSLRAEDTAVYYCAR (SEQ ID NO: 395)
RATISRDNAKNSAYLQMNSLRAEDTAVYYCAT (SEQ ID NO: 396)
RATISRDNAKNSLYMQLNSLRAEDTAVYYCAR (SEQ ID NO: 397)
RATISRDNAKNSLYMQMNSLRAEDTAVYYCAT (SEQ ID NO: 398)
RATISRDNAKNSLYLQLNSLRAEDTAVYYCAT (SEQ ID NO: 399)
RFTLSVDKAKNSLYLQMNSLRAEDTAVYYCAR (SEQ ID NO: 400)
RFTLSVDNAKSSLYLQMNSLRAEDTAVYYCAR (SEQ ID NO: 401)
RFTLSVDNAKNSAYLQMNSLRAEDTAVYYCAR (SEQ ID NO: 402)
RFTLSVDNAKNSLYMQMNSLRAEDTAVYYCAR (SEQ ID NO: 403)
RFTLSVDNAKNSLYLQLNSLRAEDTAVYYCAR (SEQ ID NO: 404)
RFTLSVDNAKNSLYLQMNSLRAEDTAVYYCAT (SEQ ID NO: 405)
RFTLSRDKASNSLYLQMNSLRAEDTAVYYCAR (SEQ ID NO: 406)
RFTLSRDKAKNSAYLQMNSLRAEDTAVYYCAR (SEQ ID NO: 407)
RFTLSRDKAKNSLYMQMNSLRAEDTAVYYCAR (SEQ ID NO: 408)
RFTLSRDKAKNSLYLQLNSLRAEDTAVYYCAR (SEQ ID NO: 409)
RFTLSRDKAKNSLYLQMNSLRAEDTAVYYCAT (SEQ ID NO: 410)
RFTLSRDNAKSSAYLQMNSLRAEDTAVYYCAR (SEQ ID NO: 411)
RFTLSRDNAKSSLYMQMNSLRAEDTAVYYCAR (SEQ ID NO: 412)
RFTLSRDNAKSSLYLQLNSLRAEDTAVYYCAR (SEQ ID NO: 413)
RFTLSRDNAKSSLYLQMNSLRAEDTAVYYCAT (SEQ ID NO: 414)
RFTLSRDNAKNSAYMQMNSLRAEDTAVYYCAR (SEQ ID NO: 415)
RFTLSRDNAKNSAYLQMNSLRAEDTAVYYCAR (SEQ ID NO: 416)
RFTLSRDNAKNSAYLQMNSLRAEDTAVYYCAT (SEQ ID NO: 417)
RFTLSRDNAKNSLYMQLNSLRAEDTAVYYCAR (SEQ ID NO: 418)
RFTLSRDNAKNSLYMQMNSLRAEDTAVYYCAT (SEQ ID NO: 419)
RFTLSRDNAKNSLYLQLNSLRAEDTAVYYCAT (SEQ ID NO: 420)
RFTISVDKAKSSLYLQMNSLRAEDTAVYYCAR (SEQ ID NO: 421)
RFTISVDKAKNSAYLQMNSLRAEDTAVYYCAR (SEQ ID NO: 422)
RFTISVDKAKNSLYMQMNSLRAEDTAVYYCAR (SEQ ID NO: 423)
RFTISVDKAKNSLYLQLNSLRAEDTAVYYCAR (SEQ ID NO: 424)
RFTISVDKAKNSLYLQMNSLRAEDTAVYYCAT (SEQ ID NO: 425)
RFTISVDNAKSSAYLQMNSLRAEDTAVYYCAR (SEQ ID NO: 426)
RFTISVDNAKSSLYMQLNSLRAEDTAVYYCAR (SEQ ID NO: 427)
RFTISVDNAKSSLYLQLNSLRAEDTAVYYCAR (SEQ ID NO: 428)
RFTISVDNAKSSLYLQMNSLRAEDTAVYYCAT (SEQ ID NO: 429)
RFTISVDNAKNSAYMQMNSLRAEDTAVYYCAR (SEQ ID NO: 430)
RFTISVDNAKNSAYLQLNSLRAEDTAVYYCAR (SEQ ID NO: 431)
RFTISVDNAKNSAYLQMNSLRAEDTAVYYCAT (SEQ ID NO: 432)
RFTISVDNAKNSLYMQLNSLRAEDTAVYYCAR (SEQ ID NO: 433)
RFTISVDNAKNSLYMQMNSLRAEDTAVYYCAT (SEQ ID NO: 434)
RFTISVDNAKNSLYLQLNSLRAEDTAVYYCAT (SEQ ID NO: 435)
RFTISRDKAKNSAYMQMNSLRAEDTAVYYCAR (SEQ ID NO: 436)
RFTISRDKAKSSLYMQMNSLRAEDTAVYYCAR (SEQ ID NO: 437)
RFTISRDKAKSSLYLQLNSLRAEDTAVYYCAR (SEQ ID NO: 438)
RFTISRDKAKSSLYLQMNSLRAEDTAVYYCAT (SEQ ID NO: 439)
RFTISRDKAKNSAYMQMNSLRAEDTAVYYCAR (SEQ ID NO: 440)
RFTISRDKAKNSAYLQLNSLRAEDTAVYYCAR (SEQ ID NO: 441)
RFTISRDKAKNSAYLQMNSLRAEDTAVYYCAR (SEQ ID NO: 442)
RFTISRDKAKNSLYMQLNSLRAEDTAVYYCAR (SEQ ID NO: 443)
RFTISRDKAKNSLYMQMNSLRAEDTAVYYCAT (SEQ ID NO: 444)
RFTISRDKAKNSLYLQLNSLRAEDTAVYYCAT (SEQ ID NO: 445)
RFTISRDNAKSSAYMQMNSLRAEDTAVYYCAR (SEQ ID NO: 446)
RFTISRDNAKSSAYLQLNSLRAEDTAVYYCAR (SEQ ID NO: 447)
RFTISRDNAKSSAYLQMNSLRAEDTAVYYCAT (SEQ ID NO: 448)
RFTISRDNAKSSLYMQLNSLRAEDTAVYYCAR (SEQ ID NO: 449)
RFTISRDNAKSSLYMQMNSLRAEDTAVYYCAT (SEQ ID NO: 450)
RFTISRDNAKSSLYLQLNSLRAEDTAVYYCAT (SEQ ID NO: 451)
RFTISRDNAKNSAYMQLNSLRAEDTAVYYCAR (SEQ ID NO: 452)
RFTISRDNAKNSAYMQMNSLRAEDTAVYYCAT (SEQ ID NO: 453)
RFTISRDNAKNSAYLQLNSLRAEDTAVYYCAT (SEQ ID NO: 454)
RFTISRDNAKNSLYMQLNSLRAEDTAVYYCAT (SEQ ID NO: 455)
RATLSVDKAKNSLYLQMNSLRAEDTAVYYCAR (SEQ ID NO: 456)
RATLSVDNAKSSLYLQMNSLRAEDTAVYYCAR (SEQ ID NO: 457)
RATLSVDNAKNSAYLQMNSLRAEDTAVYYCAR (SEQ ID NO: 458)
RATLSVDNAKNSLYMQMNSLRAEDTAVYYCAR (SEQ ID NO: 459)
RATLSVDNAKNSLYLQLNSLRAEDTAVYYCAR (SEQ ID NO: 460)
RATLSVDNAKNSLYLQMNSLRAEDTAVYYCAT (SEQ ID NO: 461)
RATLSRDKAKSSLYLQMNSLRAEDTAVYYCAR (SEQ ID NO: 462)
RATLSRDKAKNSAYLQMNSLRAEDTAVYYCAR (SEQ ID NO: 463)
RATLSRDKAKNSLYMQMNSLRAEDTAVYYCAR (SEQ ID NO: 464)
RATLSRDKAKNSLYLQLNSLRAEDTAVYYCAR (SEQ ID NO: 465)
RATLSRDKAKNSLYLQMNSLRAEDTAVYYCAT (SEQ ID NO: 466)
RATLSRDNAKSSAYLQMNSLRAEDTAVYYCAR (SEQ ID NO: 467)
RATLSRDNAKSSLYMQMNSLRAEDTAVYYCAR (SEQ ID NO: 468)
RATLSRDNAKSSLYLQLNSLRAEDTAVYYCAR (SEQ ID NO: 469)
RATLSRDNAKSSLYLQMNSLRAEDTAVYYCAT (SEQ ID NO: 470)
RATLSRDNAKNSAYMQMNSLRAEDTAVYYCAR (SEQ ID NO: 471)
RATLSRDNAKNSAYLQLNSLRAEDTAVYYCAR (SEQ ID NO: 472)
RATLSRDNAKNSAYLQMNSLRAEDTAVYYCAT (SEQ ID NO: 473)
RATLSRDNAKNSLYMQLNSLRAEDTAVYYCAR (SEQ ID NO: 474)
RATLSRDNAKNSLYMQMNSLRAEDTAVYYCAT (SEQ ID NO: 475)
RATLSRDNAKNSLYLQLNSLRAEDTAVYYCAT (SEQ ID NO: 476)
RATISVDKAKSSLYLQMNSLRAEDTAVYYCAR (SEQ ID NO: 477)
RATISVDKAKNSAYLQMNSLRAEDTAVYYCAR (SEQ ID NO: 478)
RATISVDKAKNSLYMQMNSLRAEDTAVYYCAR (SEQ ID NO: 479)
RATISVDKAKNSLYLQMNSLRAEDTAVYYCAT (SEQ ID NO: 480)
RATISVDNAKSSAYLQMNSLRAEDTAVYYCAR (SEQ ID NO: 481)
RATISVDNAKSSLYMQMNSLRAEDTAVYYCAR (SEQ ID NO: 482)
RATISVDNAKSSLYMQMNSLRAEDTAVYYCAR (SEQ ID NO: 483)
RATISVDNAKSSLYLQMNSLRAEDTAVYYCAT (SEQ ID NO: 484)
RATISVDNAKSSLYLQMNSLRAEDTAVYYCAT (SEQ ID NO: 485)
RATISVDNAKNSAYMQMNSLRAEDTAVYYCAR (SEQ ID NO: 486)
RATISVDNAKNSAYLQLNSLRAEDTAVYYCAR (SEQ ID NO: 487)
RATISVDNAKNSLYMQLNSLRAEDTAVYYCAR (SEQ ID NO: 488)
RATISVDNAKNSLYMQLNSLRAEDTAVYYCAR (SEQ ID NO: 489)
RATISVDNAKNSLYMQMNSLRAEDTAVYYCAT (SEQ ID NO: 490)
RATISVDNAKNSLYLQLNSLRAEDTAVYYCAT (SEQ ID NO: 491)
RATISRDKAKSSAYLQMNSLRAEDTAVYYCAR (SEQ ID NO: 492)
RATISRDKAKSSLYMQMNSLRAEDTAVYYCAR (SEQ ID NO: 493)
RATISRDKAKSSLYLQLNSLRAEDTAVYYCAR (SEQ ID NO: 494)
RATISRDKAKSSLYLQMNSLRAEDTAVYYCAT (SEQ ID NO: 495)
RATISRDKAKNSAYMQMNSLRAEDTAVYYCAR (SEQ ID NO: 496)
RATISRDKAKNSAYLQLNSLRAEDTAVYYCAR (SEQ ID NO: 497)
RATISRDKAKNSAYLQMNSLRAEDTAVYYCAT (SEQ ID NO: 498)
RATISRDKAKNSLYMQLNSLRAEDTAVYYCAR (SEQ ID NO: 499)
RATISRDKAKNSLYMQMNSLRAEDTAVYYCAT (SEQ ID NO: 500)
RATISRDKAKNSLYLQLNSLRAEDTAVYYCAT (SEQ ID NO: 501)
RATISRDNAKSSAYMQMNSLRAEDTAVYYCAR (SEQ ID NO: 502)
RATISRDNAKSSAYLQLNSLRAEDTAVYYCAR (SEQ ID NO: 503)
RATISRDNAKSSAYLQMNSLRAEDTAVYYCAT (SEQ ID NO: 504)
RATISRDNAKSSLYMQLNSLRAEDTAVYYCAR (SEQ ID NO: 505)
RATISRDNAKSSLYLQLNSLRAEDTAVYYCAR (SEQ ID NO: 506)
RATISRDNAKSSLYLQLNSLRAEDTAVYYCAT (SEQ ID NO: 507)
RATISRDNAKNSAYMQLNSLRAEDTAVYYCAR (SEQ ID NO: 508)
RATISRDNAKNSAYMQMNSLRAEDTAVYYCAT (SEQ ID NO: 509)
RATISRDNAKNSAYLQLNSLRAEDTAVYYCAT (SEQ ID NO: 510)
RATISRDNAKNSLYMQLNSLRAEDTAVYYCAT (SEQ ID NO: 511)
RFTLSVDKAKSSLYLQMNSLRAEDTAVYYCAR (SEQ ID NO: 512)
RFTLSVDKAKNSAYLQMNSLRAEDTAVYYCAR (SEQ ID NO: 513)
RFTLSVDKAKNSLYMQMNSLRAEDTAVYYCAR (SEQ ID NO: 514)
RFTLSVDKAKNSLYLQLNSLRAEDTAVYYCAR (SEQ ID NO: 515)
RFTLSVDKAKNSLYLQMNSLRAEDTAVYYCAT (SEQ ID NO: 516)
RFTLSVDNAKSSAYLQMNSLRAEDTAVYYCAR (SEQ ID NO: 517)
RFTLSVDNAKSSLYMQMNSLRAEDTAVYYCAR (SEQ ID NO: 518)
RFTLSVDNAKSSLYLQLNSLRAEDTAVYYCAR (SEQ ID NO: 519)
RFTLSVDNAKSSLYLQMNSLRAEDTAVYYCAT (SEQ ID NO: 520)
RFTLSVDNAKNSAYMQMNSLRAEDTAVYYCAR (SEQ ID NO: 521)
RFTLSVDNAKNSAYLQLNSLRAEDTAVYYCAR (SEQ ID NO: 522)

TABLE 6-continued

Amino Acid Sequences derived from Murine 76E1 Antibody.

```
RFTLSVDNAKNSAYLQMNSLRAEDTAVYYCAT  (SEQ ID NO: 523)
RFTLSVDNAKNSLYMQLNSLRAEDTAVYYCAR  (SEQ ID NO: 524)
RFTLSVDNAKNSLYMQMNSLRAEDTAVYYCAT  (SEQ ID NO: 525)
RFTLSVDNAKNSLYLQLNSLRAEDTAVYYCAT  (SEQ ID NO: 526)
RFTLSRDKASNSAYLQMNSLRAEDTAVYYCAR  (SEQ ID NO: 527)
RFTLSRDKASNSAYLQMNSLRAEDTAVYYCAT  (SEQ ID NO: 528)
RFTLSRDKASNSLYLQLNSLRAEDTAVYYCAR  (SEQ ID NO: 529)
RFTLSRDKASNSLYMQMNSLRAEDTAVYYCAT  (SEQ ID NO: 530)
RFTLSRDKAKNSAYMQMNSLRAEDTAVYYCAR  (SEQ ID NO: 531)
RFTLSRDKAKNSAYLQLNSLRAEDTAVYYCAR  (SEQ ID NO: 532)
RFTLSRDKAKNSAYLQMNSLRAEDTAVYYCAT  (SEQ ID NO: 533)
RFTLSRDKAKNSLYMQLNSLRAEDTAVYYCAR  (SEQ ID NO: 534)
RFTLSRDKAKNSLYMQMNSLRAEDTAVYYCAT  (SEQ ID NO: 535)
RFTLSRDKAKNSLYLQLNSLRAEDTAVYYCAT  (SEQ ID NO: 536)
RFTLSRDNAKSSAYMQMNSLRAEDTAVYYCAR  (SEQ ID NO: 537)
RFTLSRDNAKSSAYLQMNSLRAEDTAVYYCAR  (SEQ ID NO: 538)
RFTLSRDNAKSSAYLQMNSLRAEDTAVYYCAT  (SEQ ID NO: 539)
RFTLSRDNAKSSLYMQLNSLRAEDTAVYYCAR  (SEQ ID NO: 540)
RFTLSRDNAKSSLYMQMNSLRAEDTAVYYCAT  (SEQ ID NO: 541)
RFTLSRDNAKSSLYLQLNSLRAEDTAVYYCAT  (SEQ ID NO: 542)
RFTLSRDNAKNSAYMQLNSLRAEDTAVYYCAR  (SEQ ID NO: 543)
RFTLSRDNAKNSAYMQMNSLRAEDTAVYYCAT  (SEQ ID NO: 544)
RFTLSRDNAKNSAYLQLNSLRAEDTAVYYCAT  (SEQ ID NO: 545)
RFTLSRDNAKNSLYMQMNSLRAEDTAVYYCAT  (SEQ ID NO: 546)
RFTISVDKAKSSAYLQMNSLRAEDTAVYYCAR  (SEQ ID NO: 547)
RFTISVDKAKSSAYMQMNSLRAEDTAVYYCAR  (SEQ ID NO: 548)
RFTISVDKAKSSLYLQLNSLRAEDTAVYYCAR  (SEQ ID NO: 549)
RFTISVDKAKSSLYLQLNSLRAEDTAVYYCAT  (SEQ ID NO: 550)
RFTISVDKAKNSAYMQMNSLRAEDTAVYYCAR  (SEQ ID NO: 551)
RFTISVDKAKNSAYLQLNSLRAEDTAVYYCAR  (SEQ ID NO: 552)
RFTISVDKAKNSAYLQMNSLRAEDTAVYYCAT  (SEQ ID NO: 553)
RFTISVDKAKNSAYMQMNSLRAEDTAVYYCAT  (SEQ ID NO: 554)
RFTISVDKAKNSLYMQLNSLRAEDTAVYYCAT  (SEQ ID NO: 555)
RFTISVDKAKNSLYLQLNSLRAEDTAVYYCAT  (SEQ ID NO: 556)
RFTISVDNAKSSAYLQMNSLRAEDTAVYYCAR  (SEQ ID NO: 557)
RFTISVDNAKSSAYMQMNSLRAEDTAVYYCAT  (SEQ ID NO: 558)
RFTISVDNAKSSLYMQLNSLRAEDTAVYYCAR  (SEQ ID NO: 559)
RFTISVDNAKSSLYMQMNSLRAEDTAVYYCAT  (SEQ ID NO: 560)
RFTISVDNAKSSLYLQLNSLRAEDTAVYYCAT  (SEQ ID NO: 561)
RFTISVDNAKNSAYMQMNSLRAEDTAVYYCAR  (SEQ ID NO: 562)
RFTISVDNAKNSAYMQMNSLRAEDTAVYYCAT  (SEQ ID NO: 563)
RFTISVDNAKNSAYLQLNSLRAEDTAVYYCAT  (SEQ ID NO: 564)
RFTISVDNAKNSLYMQLNSLRAEDTAVYYCAR  (SEQ ID NO: 565)
RFTISRDKAKSSAYMQMNSLRAEDTAVYYCAR  (SEQ ID NO: 566)
RFTISRDKAKSSAYLQMNSLRAEDTAVYYCAT  (SEQ ID NO: 567)
RFTISRDKAKSSAYLQMNSLRAEDTAVYYCAT  (SEQ ID NO: 568)
RFTISRDKAKSSLYMQLNSLRAEDTAVYYCAR  (SEQ ID NO: 569)
RFTISRDKAKSSLYMQMNSLRAEDTAVYYCAT  (SEQ ID NO: 570)
RFTISRDKAKSSLYLQLNSLRAEDTAVYYCAT  (SEQ ID NO: 571)
RFTISRDKAKNSAYMQMNSLRAEDTAVYYCAR  (SEQ ID NO: 572)
RFTISRDKAKNSAYMQMNSLRAEDTAVYYCAT  (SEQ ID NO: 573)
RFTISRDKAKNSAYLQMNSLRAEDTAVYYCAT  (SEQ ID NO: 574)
RFTISRDKAKNSLYMQMNSLRAEDTAVYYCAT  (SEQ ID NO: 575)
RFTISRDNAKSSAYMQMNSLRAEDTAVYYCAR  (SEQ ID NO: 576)
RFTISRDNAKSSAYMQMNSLRAEDTAVYYCAT  (SEQ ID NO: 577)
RFTISRDNAKSSAYLQLNSLRAEDTAVYYCAT  (SEQ ID NO: 578)
RFTISRDNAKSSLYMQLNSLRAEDTAVYYCAT  (SEQ ID NO: 579)
RFTISRDNAKNSAYMQLNSLRAEDTAVYYCAT  (SEQ ID NO: 580)
RATLSVDKASNSLYLQMNSLRAEDTAVYYCAR  (SEQ ID NO: 581)
RATLSVDKAKNSAYLQMNSLRAEDTAVYYCAR  (SEQ ID NO: 582)
RATLSVDKAKNSLYMQMNSLRAEDTAVYYCAR  (SEQ ID NO: 583)
RATLSVDKAKNSLYLQMNSLRAEDTAVYYCAT  (SEQ ID NO: 584)
RATLSVDKAKNSLYLQLNSLRAEDTAVYYCAT  (SEQ ID NO: 585)
RATLSVDNAKSSAYLQMNSLRAEDTAVYYCAR  (SEQ ID NO: 586)
RATLSVDNAKSSLYMQMNSLRAEDTAVYYCAR  (SEQ ID NO: 587)
RATLSVDNAKSSLYMQMNSLRAEDTAVYYCAT  (SEQ ID NO: 588)
RATLSVDNAKSSLYLQLNSLRAEDTAVYYCAT  (SEQ ID NO: 589)
RATLSVDNAKNSAYMQMNSLRAEDTAVYYCAR  (SEQ ID NO: 590)
RATLSVDNAKNSAYLQMNSLRAEDTAVYYCAR  (SEQ ID NO: 591)
RATLSVDNAKNSAYLQMNSLRAEDTAVYYCAT  (SEQ ID NO: 592)
RATLSVDNAKNSLYMQLNSLRAEDTAVYYCAR  (SEQ ID NO: 593)
RATLSVDNAKNSLYLQLNSLRAEDTAVYYCAT  (SEQ ID NO: 594)
RATLSVDNAKNSLYLQLNSLRAEDTAVYYCAT  (SEQ ID NO: 595)
RATLSRDKAKSSAYMQMNSLRAEDTAVYYCAR  (SEQ ID NO: 596)
RATLSRDKAKSSLYMQMNSLRAEDTAVYYCAR  (SEQ ID NO: 597)
RATLSRDKAKSSLYLQLNSLRAEDTAVYYCAR  (SEQ ID NO: 598)
RATLSRDKAKSSLYLQLNSLRAEDTAVYYCAT  (SEQ ID NO: 599)
RATLSRDKAKNSAYMQMNSLRAEDTAVYYCAR  (SEQ ID NO: 600)
RATLSRDKAKNSAYLQLNSLRAEDTAVYYCAR  (SEQ ID NO: 601)
RATLSRDKAKNSAYLQLNSLRAEDTAVYYCAT  (SEQ ID NO: 602)
RATLSRDKAKNSLYMQLNSLRAEDTAVYYCAR  (SEQ ID NO: 603)
RATLSRDKAKNSLYMQMNSLRAEDTAVYYCAT  (SEQ ID NO: 604)
RATLSRDKAKNSLYLQLNSLRAEDTAVYYCAT  (SEQ ID NO: 605)
RATLSRDNAKSSAYMQMNSLRAEDTAVYYCAR  (SEQ ID NO: 606)
RATLSRDNAKSSAYLQLNSLRAEDTAVYYCAR  (SEQ ID NO: 607)
RATLSRDNAKSSAYLQMNSLRAEDTAVYYCAR  (SEQ ID NO: 608)
RATLSRDNAKSSLYMQLNSLRAEDTAVYYCAR  (SEQ ID NO: 609)
RATLSRDNAKSSLYMQMNSLRAEDTAVYYCAT  (SEQ ID NO: 610)
RATLSRDNAKSSLYLQLNSLRAEDTAVYYCAT  (SEQ ID NO: 611)
RATLSRDNAKNSAYMQLNSLRAEDTAVYYCAR  (SEQ ID NO: 612)
RATLSRDNAKNSAYMQMNSLRAEDTAVYYCAT  (SEQ ID NO: 613)
RATLSRDNAKNSAYLQLNSLRAEDTAVYYCAT  (SEQ ID NO: 614)
RATLSRDNAKNSLYMQMNSLRAEDTAVYYCAT  (SEQ ID NO: 615)
RATISVDKAKSSAYLQMNSLRAEDTAVYYCAR  (SEQ ID NO: 616)
RATISVDKAKSSLYMQMNSLRAEDTAVYYCAR  (SEQ ID NO: 617)
RATISVDKAKSSLYLQLNSLRAEDTAVYYCAR  (SEQ ID NO: 618)
RATISVDKAKSSLYLQLNSLRAEDTAVYYCAT  (SEQ ID NO: 619)
RATISVDKAKNSAYMQMNSLRAEDTAVYYCAR  (SEQ ID NO: 620)
RATISVDKAKNSAYLQLNSLRAEDTAVYYCAT  (SEQ ID NO: 621)
RATISVDKAKNSAYLQMNSLRAEDTAVYYCAT  (SEQ ID NO: 622)
RATISVDKAKNSLYMQLNSLRAEDTAVYYCAR  (SEQ ID NO: 623)
RATISVDKAKNSLYMQMNSLRAEDTAVYYCAT  (SEQ ID NO: 624)
RATISVDNAKSSAYMQMNSLRAEDTAVYYCAR  (SEQ ID NO: 625)
RATISVDNAKSSAYMQMNSLRAEDTAVYYCAR  (SEQ ID NO: 626)
RATISVDNAKSSAYLQLNSLRAEDTAVYYCAR  (SEQ ID NO: 627)
RATISVDNAKSSAYLQMNSLRAEDTAVYYCAT  (SEQ ID NO: 628)
RATISVDNAKSSLYMQLNSLRAEDTAVYYCAT  (SEQ ID NO: 629)
RATISVDNAKSSLYMQMNSLRAEDTAVYYCAR  (SEQ ID NO: 630)
RATISVDNAKSSLYLQLNSLRAEDTAVYYCAT  (SEQ ID NO: 631)
RATISVDNAKNSAYMQLNSLRAEDTAVYYCAR  (SEQ ID NO: 632)
RATISVDNAKNSAYMQLNSLRAEDTAVYYCAT  (SEQ ID NO: 633)
RATISVDNAKNSLYMQLNSLRAEDTAVYYCAR  (SEQ ID NO: 634)
RATISVDNAKNSLYMQMNSLRAEDTAVYYCAT  (SEQ ID NO: 635)
RATISRDKAKSSAYMQMNSLRAEDTAVYYCAR  (SEQ ID NO: 636)
RATISRDKAKSSAYLQLNSLRAEDTAVYYCAR  (SEQ ID NO: 637)
RATISRDKAKSSAYLQLNSLRAEDTAVYYCAT  (SEQ ID NO: 638)
RATISRDKAKSSLYMQLNSLRAEDTAVYYCAR  (SEQ ID NO: 639)
RATISRDKAKSSLYMQMNSLRAEDTAVYYCAT  (SEQ ID NO: 640)
RATISRDKAKSSLYLQLNSLRAEDTAVYYCAT  (SEQ ID NO: 641)
RATISRDKAKNSAYMQLNSLRAEDTAVYYCAR  (SEQ ID NO: 642)
RATISRDKAKNSAYMQMNSLRAEDTAVYYCAT  (SEQ ID NO: 643)
RATISRDKAKNSAYLQLNSLRAEDTAVYYCAT  (SEQ ID NO: 644)
RATISRDKAKNSLYMQMNSLRAEDTAVYYCAT  (SEQ ID NO: 645)
RATISRDNAKSSAYMQMNSLRAEDTAVYYCAT  (SEQ ID NO: 646)
RATISRDNAKSSAYLQMNSLRAEDTAVYYCAT  (SEQ ID NO: 647)
RATISRDNAKSSAYLQMNSLRAEDTAVYYCAT  (SEQ ID NO: 648)
RATISRDNAKSSLYMQLNSLRAEDTAVYYCAT  (SEQ ID NO: 649)
RATISRDNAKNSAYMQMNSLRAEDTAVYYCAR  (SEQ ID NO: 650)
RFTLSVDKAKSSAYLQMNSLRAEDTAVYYCAR  (SEQ ID NO: 651)
RFTLSVDKAKSSLYMQMNSLRAEDTAVYYCAR  (SEQ ID NO: 652)
RFTLSVDKAKSSLYLQLNSLRAEDTAVYYCAR  (SEQ ID NO: 653)
RFTLSVDKAKSSLYLQLNSLRAEDTAVYYCAT  (SEQ ID NO: 654)
RFTLSVDKAKNSAYLQMNSLRAEDTAVYYCAR  (SEQ ID NO: 655)
RFTLSVDKAKNSAYLQMNSLRAEDTAVYYCAR  (SEQ ID NO: 656)
RFTLSVDKAKNSAYLQMNSLRAEDTAVYYCAT  (SEQ ID NO: 657)
RFTLSVDKAKNSLYMQLNSLRAEDTAVYYCAR  (SEQ ID NO: 658)
RFTLSVDKAKNSLYMQMNSLRAEDTAVYYCAR  (SEQ ID NO: 659)
RFTLSVDKAKNSLYLQLNSLRAEDTAVYYCAT  (SEQ ID NO: 660)
RFTLSVDNAKSSAYMQMNSLRAEDTAVYYCAR  (SEQ ID NO: 661)
RFTLSVDNAKSSAYLQLNSLRAEDTAVYYCAT  (SEQ ID NO: 662)
RFTLSVDNAKSSLYMQLNSLRAEDTAVYYCAR  (SEQ ID NO: 663)
RFTLSVDNAKSSLYMQMNSLRAEDTAVYYCAR  (SEQ ID NO: 664)
RFTLSVDNAKSSLYMQMNSLRAEDTAVYYCAR  (SEQ ID NO: 665)
RFTLSVDNAKSSLYLQLNSLRAEDTAVYYCAT  (SEQ ID NO: 666)
RFTLSVDNAKSSLYLQLNSLRAEDTAVYYCAT  (SEQ ID NO: 667)
RFTLSVDNAKNSAYMQMNSLRAEDTAVYYCAR  (SEQ ID NO: 668)
RFTLSVDNAKNSAYLQLNSLRAEDTAVYYCAR  (SEQ ID NO: 669)
RFTLSVDNAKNSLYMQMNSLRAEDTAVYYCAT  (SEQ ID NO: 670)
RFTLSRDKASNSAYMQMNSLRAEDTAVYYCAR  (SEQ ID NO: 671)
RFTLSRDKASNSAYLQLNSLRAEDTAVYYCAR  (SEQ ID NO: 672)
RFTLSRDKASNSAYLQMNSLRAEDTAVYYCAR  (SEQ ID NO: 673)
RFTLSRDKASNSLYMQLNSLRAEDTAVYYCAR  (SEQ ID NO: 674)
RFTLSRDKASNSLYMQMNSLRAEDTAVYYCAT  (SEQ ID NO: 675)
RFTLSRDKASNSLYLQLNSLRAEDTAVYYCAT  (SEQ ID NO: 676)
```

TABLE 6-continued

Amino Acid Sequences derived from Murine 76E1 Antibody.

RFTLSRDKAKNSAYMQLNSLRAEDTAVYYCAR (SEQ ID NO: 677)
RFTLSRDKAKNSAYMQMNSLRAEDTAVYYCAT (SEQ ID NO: 678)
RFTLSRDKAKNSAYLQLNSLRAEDTAVYYCAT (SEQ ID NO: 679)
RFTLSRDKAKNSLYMQLNSLRAEDTAVYYCAT (SEQ ID NO: 680)
RFTLSRDNAKSSAYMQLNSLRAEDTAVYYCAT (SEQ ID NO: 681)
RFTLSRDNAKSSAYMQMNSLRAEDTAVYYCAT (SEQ ID NO: 682)
RFTLSRDNAKSSAYLQLNSLRAEDTAVYYCAT (SEQ ID NO: 683)
RFTLSRDNAKSSLYMQLNSLRAEDTAVYYCAT (SEQ ID NO: 684)
RFTLSRDNAKNSAYMQLNSLRAEDTAVYYCAT (SEQ ID NO: 685)
RFTISVDKAKSSAYMQMNSLRAEDTAVYYCAR (SEQ ID NO: 686)
RFTISVDKAKSSAYLQLNSLRAEDTAVYYCAR (SEQ ID NO: 687)
RFTISVDKAKSSAYLQMNSLRAEDTAVYYCAR (SEQ ID NO: 688)
RFTISVDKAKSSLYMQLNSLRAEDTAVYYCAR (SEQ ID NO: 689)
RFTISVDKAKSSLYMQLNSLRAEDTAVYYCAT (SEQ ID NO: 690)
RFTISVDKAKSLYLQLNSLRAEDTAVYYCAT (SEQ ID NO: 691)
RFTISVDKAKSSAYMQLNSLRAEDTAVYYCAT (SEQ ID NO: 692)
RFTISVDKAKNSAYMQMNSLRAEDTAVYYCAT (SEQ ID NO: 693)
RFTISVDKAKNSAYLQLNSLRAEDTAVYYCAT (SEQ ID NO: 694)
RFTISVDKAKNSLYMQLNSLRAEDTAVYYCAT (SEQ ID NO: 695)
RFTISVDNAKSSAYLQLNSLRAEDTAVYYCAT (SEQ ID NO: 696)
RFTISVDNAKSSLYMQLNSLRAEDTAVYYCAT (SEQ ID NO: 697)
RFTISVDNAKNSAYMQLNSLRAEDTAVYYCAT (SEQ ID NO: 698)
RFTISRDKAKSSAYMQLNSLRAEDTAVYYCAR (SEQ ID NO: 699)
RFTISRDKAKSSAYMQMNSLRAEDTAVYYCAT (SEQ ID NO: 700)
RFTISRDKAKSSAYLQLNSLRAEDTAVYYCAT (SEQ ID NO: 701)
RFTISRDKAKSSLYMQLNSLRAEDTAVYYCAT (SEQ ID NO: 702)
RFTISRDKAKNSAYMQLNSLRAEDTAVYYCAR (SEQ ID NO: 703)
RFTISRDNAKSSAYMQLNSLRAEDTAVYYCAT (SEQ ID NO: 704)
RATLSVDKASNSAYLQMNSLRAEDTAVYYCAR (SEQ ID NO: 705)
RATLSVDKASNSLYMQLNSLRAEDTAVYYCAR (SEQ ID NO: 706)
RATLSVDKASNSLYLQLNSLRAEDTAVYYCAR (SEQ ID NO: 707)
RATLSVDKASNSLYLQLNSLRAEDTAVYYCAT (SEQ ID NO: 708)
RATLSVDKAKNSAYMQLNSLRAEDTAVYYCAR (SEQ ID NO: 709)
RATLSVDKAKNSAYLQLNSLRAEDTAVYYCAR (SEQ ID NO: 710)
RATLSVDKAKNSAYLQLNSLRAEDTAVYYCAT (SEQ ID NO: 711)
RATLSVDKAKNSAYLQMNSLRAEDTAVYYCAT (SEQ ID NO: 712)
RATLSVDKAKNSLYMQLNSLRAEDTAVYYCAT (SEQ ID NO: 713)
RATLSVDKAKNSLYLQLNSLRAEDTAVYYCAT (SEQ ID NO: 714)
RATLSVDNAKSSAYMQLNSLRAEDTAVYYCAR (SEQ ID NO: 715)
RATLSVDNAKSSAYMQLNSLRAEDTAVYYCAR (SEQ ID NO: 716)
RATLSVDNAKSSAYLQLNSLRAEDTAVYYCAT (SEQ ID NO: 717)
RATLSVDNAKSSLYMQLNSLRAEDTAVYYCAT (SEQ ID NO: 718)
RATLSVDNAKSSLYMQLNSLRAEDTAVYYCAT (SEQ ID NO: 719)
RATLSVDNAKSSLYLQLNSLRAEDTAVYYCAT (SEQ ID NO: 720)
RATLSVDNAKNSAYMQLNSLRAEDTAVYYCAT (SEQ ID NO: 721)
RATLSVDNAKNSAYMQMNSLRAEDTAVYYCAT (SEQ ID NO: 722)
RATLSVDNAKNSAYLQLNSLRAEDTAVYYCAT (SEQ ID NO: 723)
RATLSVDNAKNSLYMQLNSLRAEDTAVYYCAT (SEQ ID NO: 724)
RATLSRDKAKSSAYMQMNSLRAEDTAVYYCAT (SEQ ID NO: 725)
RATLSRDKAKSSAYLQLNSLRAEDTAVYYCAR (SEQ ID NO: 726)
RATLSRDKAKSSAYMQLNSLRAEDTAVYYCAR (SEQ ID NO: 727)
RATLSRDKAKSSLYMQLNSLRAEDTAVYYCAR (SEQ ID NO: 728)
RATLSRDKAKSSLYMQLNSLRAEDTAVYYCAT (SEQ ID NO: 729)
RATLSRDKAKSSLYLQLNSLRAEDTAVYYCAT (SEQ ID NO: 730)
RATLSRDKAKNSAYMQMNSLRAEDTAVYYCAT (SEQ ID NO: 731)
RATLSRDKAKNSAYMQMNSLRAEDTAVYYCAT (SEQ ID NO: 732)
RATLSRDKAKNSAYLQLNSLRAEDTAVYYCAT (SEQ ID NO: 733)
RATLSRDKAKNSLYMQLNSLRAEDTAVYYCAT (SEQ ID NO: 734)
RATLSRDNAKSSAYMQLNSLRAEDTAVYYCAR (SEQ ID NO: 735)
RATLSRDNAKSSAYMQLNSLRAEDTAVYYCAT (SEQ ID NO: 736)
RATLSRDNAKSSAYLQLNSLRAEDTAVYYCAT (SEQ ID NO: 737)
RATLSRDNAKSSLYMQLNSLRAEDTAVYYCAT (SEQ ID NO: 738)
RATLSRDNAKNSAYMQLNSLRAEDTAVYYCAT (SEQ ID NO: 739)
RATISVDKAKSSAYMQLNSLRAEDTAVYYCAR (SEQ ID NO: 740)
RATISVDKAKSSAYLQLNSLRAEDTAVYYCAR (SEQ ID NO: 741)
RATISVDKAKSSAYMQLNSLRAEDTAVYYCAT (SEQ ID NO: 742)
RATISVDKAKSSLYMQLNSLRAEDTAVYYCAR (SEQ ID NO: 743)
RATISVDKAKSSLYMQLNSLRAEDTAVYYCAT (SEQ ID NO: 744)
RATISVDKAKSSLYLQLNSLRAEDTAVYYCAT (SEQ ID NO: 745)
RATISVDKAKNSAYMQLNSLRAEDTAVYYCAT (SEQ ID NO: 746)
RATISVDKAKNSAYMQMNSLRAEDTAVYYCAT (SEQ ID NO: 747)
RATISVDKAKNSAYLQLNSLRAEDTAVYYCAT (SEQ ID NO: 748)
RATISVDKAKNSLYMQLNSLRAEDTAVYYCAT (SEQ ID NO: 749)
RATISVDNAKSSAYMQMNSLRAEDTAVYYCAT (SEQ ID NO: 750)
RATISVDNAKSSAYMQMNSLRAEDTAVYYCAT (SEQ ID NO: 751)
RATISVDNAKSSAYLQLNSLRAEDTAVYYCAT (SEQ ID NO: 752)
RATISVDNAKSSLYMQLNSLRAEDTAVYYCAT (SEQ ID NO: 753)
RATISVDNAKNSAYMQLNSLRAEDTAVYYCAT (SEQ ID NO: 754)
RATISRDKAKSSAYMQLNSLRAEDTAVYYCAR (SEQ ID NO: 755)
RATISRDKAKSSAYMQMNSLRAEDTAVYYCAT (SEQ ID NO: 756)
RATISRDKAKSSAYLQLNSLRAEDTAVYYCAT (SEQ ID NO: 757)
RATISRDKAKSSLYMQLNSLRAEDTAVYYCAT (SEQ ID NO: 758)
RATISRDKAKNSAYMQLNSLRAEDTAVYYCAT (SEQ ID NO: 759)
RATISRDNAKSSAYMQLNSLRAEDTAVYYCAT (SEQ ID NO: 760)
RFTLSVDKAKSSAYMQMNSLRAEDTAVYYCAR (SEQ ID NO: 761)
RFTLSVDKAKSSAYLQLNSLRAEDTAVYYCAR (SEQ ID NO: 762)
RFTLSVDKAKSSAYLQMNSLRAEDTAVYYCAR (SEQ ID NO: 763)
RFTLSVDKAKSSLYMQLNSLRAEDTAVYYCAR (SEQ ID NO: 764)
RFTLSVDKAKSSLYMQLNSLRAEDTAVYYCAT (SEQ ID NO: 765)
RFTLSVDKAKSSLYLQLNSLRAEDTAVYYCAT (SEQ ID NO: 766)
RFTLSVDKAKNSAYMQLNSLRAEDTAVYYCAT (SEQ ID NO: 767)
RFTLSVDKAKNSAYMQMNSLRAEDTAVYYCAT (SEQ ID NO: 768)
RFTLSVDKAKNSAYLQLNSLRAEDTAVYYCAT (SEQ ID NO: 769)
RFTLSVDKAKNSLYMQLNSLRAEDTAVYYCAT (SEQ ID NO: 770)
RFTLSVDNAKSSAYMQLNSLRAEDTAVYYCAT (SEQ ID NO: 771)
RFTLSVDNAKSSAYMQMNSLRAEDTAVYYCAT (SEQ ID NO: 772)
RFTLSVDNAKSSAYLQLNSLRAEDTAVYYCAT (SEQ ID NO: 773)
RFTLSVDNAKSSLYMQLNSLRAEDTAVYYCAT (SEQ ID NO: 774)
RFTLSVDNAKNSAYMQLNSLRAEDTAVYYCAT (SEQ ID NO: 775)
RFTLSRDKASNSAYMQLNSLRAEDTAVYYCAR (SEQ ID NO: 776)
RFTLSRDKASNSAYMQMNSLRAEDTAVYYCAT (SEQ ID NO: 777)
RFTLSRDKASNSAYLQLNSLRAEDTAVYYCAT (SEQ ID NO: 778)
RFTLSRDKASNSLYMQLNSLRAEDTAVYYCAT (SEQ ID NO: 779)
RFTLSRDKAKNSAYMQLNSLRAEDTAVYYCAT (SEQ ID NO: 780)
RFTLSRDNAKSSAYMQLNSLRAEDTAVYYCAT (SEQ ID NO: 781)
RFTISVDKAKSSAYMQLNSLRAEDTAVYYCAR (SEQ ID NO: 782)
RFTISVDKAKSSAYMQLNSLRAEDTAVYYCAT (SEQ ID NO: 783)
RFTISVDKAKSSAYLQLNSLRAEDTAVYYCAT (SEQ ID NO: 784)
RFTISVDKAKSSLYMQLNSLRAEDTAVYYCAT (SEQ ID NO: 785)
RFTISVDKAKNSAYMQLNSLRAEDTAVYYCAT (SEQ ID NO: 786)
RFTISRDKAKSSAYMQLNSLRAEDTAVYYCAT (SEQ ID NO: 787)
RATLSVDKASNSAYMQMNSLRAEDTAVYYCAR (SEQ ID NO: 788)
RATLSVDKASNSAYLQLNSLRAEDTAVYYCAR (SEQ ID NO: 789)
RATLSVDKASNSAYLQLNSLRAEDTAVYYCAT (SEQ ID NO: 790)
RATLSVDKASNSLYMQLNSLRAEDTAVYYCAR (SEQ ID NO: 791)
RATLSVDKASNSLYMQLNSLRAEDTAVYYCAT (SEQ ID NO: 792)
RATLSVDKASNSLYLQLNSLRAEDTAVYYCAT (SEQ ID NO: 793)
RATLSVDKAKNSAYMQLNSLRAEDTAVYYCAR (SEQ ID NO: 794)
RATLSVDKAKNSAYMQMNSLRAEDTAVYYCAT (SEQ ID NO: 795)
RATLSVDKAKNSAYLQLNSLRAEDTAVYYCAT (SEQ ID NO: 796)
RATLSVDKAKNSLYMQLNSLRAEDTAVYYCAT (SEQ ID NO: 797)
RATLSVDNAKSSAYMQLNSLRAEDTAVYYCAR (SEQ ID NO: 798)
RATLSVDNAKSSAYMQMNSLRAEDTAVYYCAT (SEQ ID NO: 799)
RATLSVDNAKSSAYLQLNSLRAEDTAVYYCAT (SEQ ID NO: 800)
RATLSVDNAKSSLYMQLNSLRAEDTAVYYCAT (SEQ ID NO: 801)
RATLSVDNAKNSAYMQLNSLRAEDTAVYYCAT (SEQ ID NO: 802)
RATLSRDKAKSSAYMQLNSLRAEDTAVYYCAR (SEQ ID NO: 803)
RATLSRDKAKSSAYMQLNSLRAEDTAVYYCAR (SEQ ID NO: 804)
RATLSRDKAKSSAYLQLNSLRAEDTAVYYCAT (SEQ ID NO: 805)
RATLSRDKAKSSLYMQLNSLRAEDTAVYYCAR (SEQ ID NO: 806)
RATLSRDKAKNSAYMQLNSLRAEDTAVYYCAT (SEQ ID NO: 807)
RATLSRDNAKSSAYMQLNSLRAEDTAVYYCAT (SEQ ID NO: 808)
RAATISVDKAKSSAYMQLNSLRAEDTAVYYCAR (SEQ ID NO: 809)
RAATISVDKAKSSAYMQMNSLRAEDTAVYYCAT (SEQ ID NO: 810)
RAATISVDKAKSSAYLQLNSLRAEDTAVYYCAT (SEQ ID NO: 811)
RATISVDKAKSSLYMQLNSLRAEDTAVYYCAT (SEQ ID NO: 812)
RATISVDKAKNSAYMQLNSLRAEDTAVYYCAT (SEQ ID NO: 813)
RATISVDNAKSSAYMQLNSLRAEDTAVYYCAT (SEQ ID NO: 814)
RATISRDKAKSSAYMQLNSLRAEDTAVYYCAT (SEQ ID NO: 815)
RFTLSVDKAKSSAYMQLNSLRAEDTAVYYCAR (SEQ ID NO: 816)
RFTLSVDKAKSSAYMQLNSLRAEDTAVYYCAT (SEQ ID NO: 817)
RFTLSVDKAKSSAYLQLNSLRAEDTAVYYCAT (SEQ ID NO: 818)
RFTLSVDKAKSSLYMQLNSLRAEDTAVYYCAT (SEQ ID NO: 819)
RFTLSVDKAKNSAYMQLNSLRAEDTAVYYCAT (SEQ ID NO: 820)
RFTLSVDNAKSSAYMQLNSLRAEDTAVYYCAT (SEQ ID NO: 821)
RFTLSRDKASNSAYMQLNSLRAEDTAVYYCAT (SEQ ID NO: 822)
RFTISVDKAKSSAYMQLNSLRAEDTAVYYCAT (SEQ ID NO: 823)
RATLSVDKASNSAYMQLNSLRAEDTAVYYCAR (SEQ ID NO: 824)
RATLSVDKASNSAYMQLNSLRAEDTAVYYCAT (SEQ ID NO: 825)
RATLSVDKASNSAYLQLNSLRAEDTAVYYCAT (SEQ ID NO: 826)
RATLSVDKASNSLYMQLNSLRAEDTAVYYCAT (SEQ ID NO: 827)
RATLSVDKAKNSAYMQLNSLRAEDTAVYYCAT (SEQ ID NO: 828)
RATLSVDNAKSSAYMQLNSLRAEDTAVYYCAT (SEQ ID NO: 829)
RATLSRDKAKSSAYMQLNSLRAEDTAVYYCAT (SEQ ID NO: 830)

TABLE 6-continued

Amino Acid Sequences derived from Murine 76E1 Antibody.

RATISVDKAKSSAYMQLNSLRAEDTAVYYCAT (SEQ ID NO: 831)
RFTLSVDKAKSSAYMQLNSLRAEDTAVYYCAT (SEQ ID NO: 832)
RATLSVDKASNSAYMQLNSLRAEDTAVYYCAT (SEQ ID NO: 833)

76E1-huVH3a VH CDR3
STMITPFDY (SEQ ID NO: 32)
STLITPFDY (SEQ ID NO: 319)

76E1-huVH3a VH FR4
WGQGTLVTVSS (SEQ ID NO: 54)
WGQGTLLTVSS (SEQ ID NO: 320)

76E1-huVH3b Variable Region
EVQLVESGGGLVQPGGSLRLSCAASGYSFTGYNMNWVRQAPGKGLEWVSN
IDPYYDYTSYADSVKGRFTISRDNAKNSLYLQMNSLRAEDTAVYYCARST
MITPFDYWGQGTLVTVSS
(SEQ ID NO: 15)

76E1-huVH3b VH FR1
EVQLVESGGGLVQPGGSLRLSCAAS (SEQ ID NO: 55)
EVQLVQSGGGLVQPGGSLRLSCAAS (SEQ ID NO: 115)
EVQLVESGGGLVQPGGSVRLSCAAS (SEQ ID NO: 116)
EVQLVESGGGLVQPGGSLRISCAAS (SEQ ID NO: 117)
EVQLVQSGGGLVQPGGSVRLSCAAS (SEQ ID NO: 118)
EVQLVESGGGLVQPGGSVRISCAAS (SEQ ID NO: 119)
EVQLVQSGGGLVQPGGSLRISCAAS (SEQ ID NO: 120)
EVQLVQSGGGLVQPGGSVRISCAAS (SEQ ID NO: 121)

76E1-huVH3b VH CDR1
GYSFTGYNMN (SEQ ID NO: 30)
GYSFTGYQMN (SEQ ID NO: 59)
GYSFTGYSMN (SEQ ID NO: 60)
GYSFTGYDMN (SEQ ID NO: 61)
GYSFTGYAMN (SEQ ID NO: 62)

76E1-huVH3b VH FR2
WVRQAPGKGLEWVS (SEQ ID NO: 56)
WVRQAPGKSLEWVS (SEQ ID NO: 323)
WVRQAPGKGLEWIS (SEQ ID NO: 122)
WVRQAPGKGLEWVG (SEQ ID NO: 123)
WVRQAPGKSLEWIS (SEQ ID NO: 324)
WVRQAPGKSLEWVG (SEQ ID NO: 325)
WVRQAPGKGLEWIG (SEQ ID NO: 124)
WVRQAPGKSLEWIG (SEQ ID NO: 326)

76E1-huVH3b VH CDR2*
NIDPYYDYTSYADSVKG (SEQ ID NO: 835)
NIEPYYDYTSYADSVKG (SEQ ID NO: 836)
NISPYYDYTSYADSVKG (SEQ ID NO: 837)
NIAPYYDYTSYADSVKG (SEQ ID NO: 838)
NIDPYYDYTSYADSVKG (SEQ ID NO: 839)
NIEPYYDYTSYADSVKG (SEQ ID NO: 840)
NISPYYDYTSYADSVKG (SEQ ID NO: 841)
NIAPYYDYTSYADSVKG (SEQ ID NO: 842)

76E1-huVH3b VH FR3
RFTISRDNAKNSLYLQMNSLRAEDTAVYYCAR (SEQ ID NO: 57)
RATISRDNAKNSLYLQMNSLRAEDTAVYYCAR (SEQ ID NO: 327)
RFTLSRDNAKNSLYLQMNSLRAEDTAVYYCAR (SEQ ID NO: 328)
RFTISVDNAKNSLYLQMNSLRAEDTAVYYCAR (SEQ ID NO: 329)
RFTISRDKAKNSLYLQMNSLRAEDTAVYYCAR (SEQ ID NO: 330)
RFTISRDNAKSSLYLQMNSLRAEDTAVYYCAR (SEQ ID NO: 331)
RFTISRDNAKNSAYLQMNSLRAEDTAVYYCAR (SEQ ID NO: 332)
RFTISRDNAKNSLYMQMNSLRAEDTAVYYCAR (SEQ ID NO: 333)
RFTISRDNAKNSLYLQLNSLRAEDTAVYYCAR (SEQ ID NO: 334)
RFTISRDNAKNSLYLQMNSLRAEDTAVYYCAT (SEQ ID NO: 335)
RATLSRDNAKNSLYLQMNSLRAEDTAVYYCAR (SEQ ID NO: 336)
RATISVDNAKNSLYLQMNSLRAEDTAVYYCAR (SEQ ID NO: 337)
RATISRDKAKNSLYLQMNSLRAEDTAVYYCAR (SEQ ID NO: 338)
RATISRDNAKSSLYLQMNSLRAEDTAVYYCAR (SEQ ID NO: 339)
RATISRDNAKNSAYLQMNSLRAEDTAVYYCAR (SEQ ID NO: 340)
RATISRDNAKNSLYMQMNSLRAEDTAVYYCAR (SEQ ID NO: 341)
RATISRDNAKNSLYLQLNSLRAEDTAVYYCAR (SEQ ID NO: 342)
RATISRDNAKNSLYLQMNSLRAEDTAVYYCAT (SEQ ID NO: 343)
RFTLSVDNAKNSLYLQMNSLRAEDTAVYYCAR (SEQ ID NO: 344)
RFTLSRDKAKNSLYLQMNSLRAEDTAVYYCAR (SEQ ID NO: 345)
RFTLSRDNAKSSLYLQMNSLRAEDTAVYYCAR (SEQ ID NO: 346)
RFTLSRDNAKNSAYLQMNSLRAEDTAVYYCAR (SEQ ID NO: 347)
RFTLSRDNAKNSLYMQMNSLRAEDTAVYYCAR (SEQ ID NO: 348)
RFTLSRDNAKNSLYLQLNSLRAEDTAVYYCAR (SEQ ID NO: 349)
RFTLSRDNAKNSLYLQMNSLRAEDTAVYYCAT (SEQ ID NO: 350)
RFTISVDNAKSSLYLQMNSLRAEDTAVYYCAR (SEQ ID NO: 351)
RFTISVDNAKSSLYLQMNSLRAEDTAVYYCAR (SEQ ID NO: 352)
RFTISVDNAKNSAYLQMNSLRAEDTAVYYCAR (SEQ ID NO: 353)
RFTISVDNAKNSLYMQMNSLRAEDTAVYYCAR (SEQ ID NO: 354)
RFTISVDNAKNSLYLQLNSLRAEDTAVYYCAR (SEQ ID NO: 355)
RFTISVDNAKNSLYLQMNSLRAEDTAVYYCAT (SEQ ID NO: 356)
RFTISRDKAKSSLYLQMNSLRAEDTAVYYCAR (SEQ ID NO: 357)
RFTISRDKAKNSAYLQMNSLRAEDTAVYYCAR (SEQ ID NO: 358)
RFTISRDKAKNSLYMQMNSLRAEDTAVYYCAR (SEQ ID NO: 359)
RFTISRDKAKNSLYLQLNSLRAEDTAVYYCAR (SEQ ID NO: 360)
RFTISRDKAKNSLYLQMNSLRAEDTAVYYCAT (SEQ ID NO: 361)
RFTISRDNAKSSYLQMNSLRAEDTAVYYCAR (SEQ ID NO: 362)
RFTISRDNAKSSLYMQMNSLRAEDTAVYYCAR (SEQ ID NO: 363)
RFTISRDNAKSSLYLQLNSLRAEDTAVYYCAR (SEQ ID NO: 364)
RFTISRDNAKSSLYLQMNSLRAEDTAVYYCAT (SEQ ID NO: 365)
RFTISRDNAKNSAYMQMNSLRAEDTAVYYCAR (SEQ ID NO: 366)
RFTISRDNAKNSAYLQLNSLRAEDTAVYYCAR (SEQ ID NO: 367)
RFTISRDNAKNSAYLQMNSLRAEDTAVYYCAT (SEQ ID NO: 368)
RFTISRDNAKNSLYMQLNSLRAEDTAVYYCAR (SEQ ID NO: 369)
RFTISRDNAKNSLYMQMNSLRAEDTAVYYCAT (SEQ ID NO: 370)
RFTISRDNAKNSLYLQLNSLRAEDTAVYYCAT (SEQ ID NO: 371)
RATLSVDNAKSSLYLQMNSLRAEDTAVYYCAR (SEQ ID NO: 372)
RATLSRDKAKNSLYLQMNSLRAEDTAVYYCAR (SEQ ID NO: 373)
RATLSRDNAKSSLYLQMNSLRAEDTAVYYCAR (SEQ ID NO: 374)
RATLSRDNAKNSAYLQMNSLRAEDTAVYYCAR (SEQ ID NO: 375)
RATLSRDNAKNSLYMQMNSLRAEDTAVYYCAR (SEQ ID NO: 376)
RATLSRDNAKNSLYLQLNSLRAEDTAVYYCAR (SEQ ID NO: 377)
RATLSRDNAKNSLYLQMNSLRAEDTAVYYCAT (SEQ ID NO: 378)
RATISVDNAKSSLYLQMNSLRAEDTAVYYCAR (SEQ ID NO: 379)
RATISVDNAKSSLYLQMNSLRAEDTAVYYCAR (SEQ ID NO: 380)
RATISVDNAKNSAYLQMNSLRAEDTAVYYCAR (SEQ ID NO: 381)
RATISVDNAKNSLYMQMNSLRAEDTAVYYCAR (SEQ ID NO: 382)
RATISVDNAKNSLYLQLNSLRAEDTAVYYCAR (SEQ ID NO: 383)
RATISVDNAKNSLYLQMNSLRAEDTAVYYCAT (SEQ ID NO: 384)
RATISRDKAKSSLYLQMNSLRAEDTAVYYCAR (SEQ ID NO: 385)
RATISRDKAKNSAYLQMNSLRAEDTAVYYCAR (SEQ ID NO: 386)
RATISRDKAKNSLYMQMNSLRAEDTAVYYCAR (SEQ ID NO: 387)
RATISRDKAKNSLYLQLNSLRAEDTAVYYCAR (SEQ ID NO: 388)
RATISRDKAKNSLYLQMNSLRAEDTAVYYCAT (SEQ ID NO: 389)
RATISRDNAKSSAYLQMNSLRAEDTAVYYCAR (SEQ ID NO: 390)
RATISRDNAKSSLYMQMNSLRAEDTAVYYCAR (SEQ ID NO: 391)
RATISRDNAKSSLYLQLNSLRAEDTAVYYCAR (SEQ ID NO: 392)
RATISRDNAKSSLYLQMNSLRAEDTAVYYCAT (SEQ ID NO: 393)
RATISRDNAKNSAYMQMNSLRAEDTAVYYCAR (SEQ ID NO: 394)
RATISRDNAKNSAYLQLNSLRAEDTAVYYCAR (SEQ ID NO: 395)
RATISRDNAKNSAYLQMNSLRAEDTAVYYCAT (SEQ ID NO: 396)
RATISRDNAKNSLYMQLNSLRAEDTAVYYCAR (SEQ ID NO: 397)
RATISRDNAKNSLYMQMNSLRAEDTAVYYCAT (SEQ ID NO: 398)
RATISRDNAKNSLYLQLNSLRAEDTAVYYCAT (SEQ ID NO: 399)
RFTLSVDNAKNSLYLQMNSLRAEDTAVYYCAR (SEQ ID NO: 400)
RFTLSVDNAKSSLYLQMNSLRAEDTAVYYCAR (SEQ ID NO: 401)
RFTLSVDNAKNSAYLQMNSLRAEDTAVYYCAR (SEQ ID NO: 402)
RFTLSVDNAKNSLYMQMNSLRAEDTAVYYCAR (SEQ ID NO: 403)
RFTLSVDNAKNSLYLQLNSLRAEDTAVYYCAR (SEQ ID NO: 404)
RFTLSVDNAKNSLYLQMNSLRAEDTAVYYCAT (SEQ ID NO: 405)
RFTLSRDKASNSLYLQMNSLRAEDTAVYYCAR (SEQ ID NO: 406)
RFTLSRDKAKNSAYLQMNSLRAEDTAVYYCAR (SEQ ID NO: 407)
RFTLSRDKAKNSLYMQMNSLRAEDTAVYYCAR (SEQ ID NO: 408)
RFTLSRDKAKNSLYLQLNSLRAEDTAVYYCAR (SEQ ID NO: 409)
RFTLSRDKAKNSLYLQMNSLRAEDTAVYYCAT (SEQ ID NO: 410)
RFTLSRDNAKSSAYLQMNSLRAEDTAVYYCAR (SEQ ID NO: 411)
RFTLSRDNAKSSLYMQMNSLRAEDTAVYYCAR (SEQ ID NO: 412)
RFTLSRDNAKSSLYLQLNSLRAEDTAVYYCAR (SEQ ID NO: 413)
RFTLSRDNAKSSLYLQMNSLRAEDTAVYYCAT (SEQ ID NO: 414)
RFTLSRDNAKNSAYMQMNSLRAEDTAVYYCAR (SEQ ID NO: 415)
RFTLSRDNAKNSAYLQLNSLRAEDTAVYYCAR (SEQ ID NO: 416)
RFTLSRDNAKNSAYLQMNSLRAEDTAVYYCAT (SEQ ID NO: 417)
RFTLSRDNAKNSLYMQLNSLRAEDTAVYYCAR (SEQ ID NO: 418)
RFTLSRDNAKNSLYMQMNSLRAEDTAVYYCAT (SEQ ID NO: 419)
RFTLSRDNAKNSLYLQLNSLRAEDTAVYYCAT (SEQ ID NO: 420)
RFTISVDKAKSSLYLQMNSLRAEDTAVYYCAR (SEQ ID NO: 421)
RFTISVDKAKNSAYLQMNSLRAEDTAVYYCAR (SEQ ID NO: 422)
RFTISVDKAKNSLYMQMNSLRAEDTAVYYCAR (SEQ ID NO: 423)

TABLE 6-continued

Amino Acid Sequences derived from Murine 76E1 Antibody.

RFTISVDKAKNSLYLQLNSLRAEDTAVYYCAR (SEQ ID NO: 424)
RFTISVDKAKNSLYLQMNSLRAEDTAVYYCAT (SEQ ID NO: 425)
RFTISVDNAKSSAYLQMNSLRAEDTAVYYCAT (SEQ ID NO: 426)
RFTISVDNAKSSLYMQMNSLRAEDTAVYYCAR (SEQ ID NO: 427)
RFTISVDNAKSSLYLQLNSLRAEDTAVYYCAR (SEQ ID NO: 428)
RFTISVDNAKSSLYLQLNSLRAEDTAVYYCAT (SEQ ID NO: 429)
RFTISVDNAKNSAYMQMNSLRAEDTAVYYCAR (SEQ ID NO: 430)
RFTISVDNAKNSAYLQLNSLRAEDTAVYYCAR (SEQ ID NO: 431)
RFTISVDNAKNSAYLQMNSLRAEDTAVYYCAT (SEQ ID NO: 432)
RFTISVDNAKNSLYMQLNSLRAEDTAVYYCAR (SEQ ID NO: 433)
RFTISVDNAKNSLYMQMNSLRAEDTAVYYCAT (SEQ ID NO: 434)
RFTISVDNAKNSLYLQLNSLRAEDTAVYYCAT (SEQ ID NO: 435)
RFTISRDKAKSS**AYLQMNSLRAEDTAVYYCAR (SEQ ID NO: 436)
RFTISRDKAKSSLYM**QMNSLRAEDTAVYYCAR (SEQ ID NO: 437)
RFTISRDKAKSSLYLQL**NSLRAEDTAVYYCAR (SEQ ID NO: 438)
RFTISRDKAKSSLYLQMNSLRAEDTAVYYCAT** (SEQ ID NO: 439)
RFTISRDKAKNSAYM**QMNSLRAEDTAVYYCAR (SEQ ID NO: 440)
RFTISRDKAKNSAYLQLNSLRAEDTAVYYCAR (SEQ ID NO: 441)
RFTISRDKAKNSAYLQMNSLRAEDTAVYYCAT (SEQ ID NO: 442)
RFTISRDKAKNSLYMQLNSLRAEDTAVYYCAR (SEQ ID NO: 443)
RFTISRDKAKNSLYMQMNSLRAEDTAVYYCAT (SEQ ID NO: 444)
RFTISRDKAKNSLYLQLNSLRAEDTAVYYCAT** (SEQ ID NO: 445)
RFTISRDNAKSSAYMQMNSLRAEDTAVYYCAR (SEQ ID NO: 446)
RFTISRDNAKSSAYLQLNSLRAEDTAVYYCAR (SEQ ID NO: 447)
RFTISRDNAKSSAYLQMNSLRAEDTAVYYCAT (SEQ ID NO: 448)
RFTISRDNAKSSLYMQLNSLRAEDTAVYYCAR (SEQ ID NO: 449)
RFTISRDNAKSSLYMQMNSLRAEDTAVYYCAT (SEQ ID NO: 450)
RFTISRDNAKSSLYLQLNSLRAEDTAVYYCAT (SEQ ID NO: 451)
RFTISRDNAKNSAYMQLNSLRAEDTAVYYCAR (SEQ ID NO: 452)
RFTISRDNAKNSAYMQMNSLRAEDTAVYYCAT (SEQ ID NO: 453)
RFTISRDNAKNSAYLQLNSLRAEDTAVYYCAT** (SEQ ID NO: 454)
RFTISRDNAKNSLYMQLNSLRAEDTAVYYCAT (SEQ ID NO: 455)
RATLSVDKAKNSLYLQMNSLRAEDTAVYYCAR (SEQ ID NO: 456)
RATLSVDNAKSSLYLQMNSLRAEDTAVYYCAR (SEQ ID NO: 457)
RATLSVDNAKNSAYLQMNSLRAEDTAVYYCAR (SEQ ID NO: 458)
RATLSVDNAKNSLYMQMNSLRAEDTAVYYCAR (SEQ ID NO: 459)
RATLSVDNAKNSLYLQLNSLRAEDTAVYYCAR (SEQ ID NO: 460)
RATLSVDNAKNSLYLQMNSLRAEDTAVYYCAT (SEQ ID NO: 461)
RATLSRDKAKNSAYLQMNSLRAEDTAVYYCAR (SEQ ID NO: 462)
RATLSRDKAKNSLYMQMNSLRAEDTAVYYCAR (SEQ ID NO: 463)
RATLSRDKAKNSLYLQLNSLRAEDTAVYYCAR (SEQ ID NO: 464)
RATLSRDKAKNSLYLQLNSLRAEDTAVYYCAR (SEQ ID NO: 465)
RATLSRDKAKNSLYLQMNSLRAEDTAVYYCAT (SEQ ID NO: 466)
RATLSRDNAKSSAYLQMNSLRAEDTAVYYCAR (SEQ ID NO: 467)
RATLSRDNAKSSLYMQMNSLRAEDTAVYYCAR (SEQ ID NO: 468)
RATLSRDNAKSSLYLQLNSLRAEDTAVYYCAR (SEQ ID NO: 469)
RATLSRDNAKSSLYLQMNSLRAEDTAVYYCAT (SEQ ID NO: 470)
RATLSRDNAKNSAYMQMNSLRAEDTAVYYCAR (SEQ ID NO: 471)
RATLSRDNAKNSAYLQLNSLRAEDTAVYYCAR (SEQ ID NO: 472)
RATLSRDNAKNSAYLQMNSLRAEDTAVYYCAT (SEQ ID NO: 473)
RATLSRDNAKNSLYMQLNSLRAEDTAVYYCAR (SEQ ID NO: 474)
RATLSRDNAKNSLYMQMNSLRAEDTAVYYCAT (SEQ ID NO: 475)
RATLSRDNAKNSLYLQLNSLRAEDTAVYYCAT (SEQ ID NO: 476)
RATISVDKAKSSLYLQMNSLRAEDTAVYYCAR (SEQ ID NO: 477)
RATISVDKAKNSAYLQMNSLRAEDTAVYYCAR (SEQ ID NO: 478)
RATISVDKAKNSLYMQMNSLRAEDTAVYYCAR (SEQ ID NO: 479)
RATISVDKAKNSLYLQLNSLRAEDTAVYYCAR (SEQ ID NO: 480)
RATISVDKAKNSLYLQMNSLRAEDTAVYYCAT (SEQ ID NO: 481)
RATISVDNAKSSAYLQMNSLRAEDTAVYYCAR (SEQ ID NO: 482)
RATISVDNAKSSLYMQMNSLRAEDTAVYYCAR (SEQ ID NO: 483)
RATISVDNAKSSLYLQLNSLRAEDTAVYYCAR (SEQ ID NO: 484)
RATISVDNAKSSLYLQMNSLRAEDTAVYYCAT (SEQ ID NO: 485)
RATISVDNAKNSAYMQMNSLRAEDTAVYYCAR (SEQ ID NO: 486)
RATISVDNAKNSAYLQLNSLRAEDTAVYYCAR (SEQ ID NO: 487)
RATISVDNAKNSAYLQMNSLRAEDTAVYYCAT (SEQ ID NO: 488)
RATISVDNAKNSLYMQLNSLRAEDTAVYYCAR (SEQ ID NO: 489)
RATISVDNAKNSLYMQMNSLRAEDTAVYYCAT (SEQ ID NO: 490)
RATISVDNAKNSLYLQLNSLRAEDTAVYYCAT (SEQ ID NO: 491)
RATISRDKAKSS**AYLQMNSLRAEDTAVYYCAR (SEQ ID NO: 492)
RATISRDKAKSSLYM**QMNSLRAEDTAVYYCAR (SEQ ID NO: 493)
RATISRDKAKSSLYLQL**NSLRAEDTAVYYCAR (SEQ ID NO: 494)
RATISRDKAKSSLYLQMNSLRAEDTAVYYCAT** (SEQ ID NO: 495)
RATISRDKAKNSAYM**QMNSLRAEDTAVYYCAR (SEQ ID NO: 496)
RATISRDKAKNSAYLQLNSLRAEDTAVYYCAR (SEQ ID NO: 497)
RATISRDKAKNSAYLQMNSLRAEDTAVYYCAT (SEQ ID NO: 498)
RATISRDKAKNSLYMQLNSLRAEDTAVYYCAR (SEQ ID NO: 499)
RATISRDKAKNSLYMQMNSLRAEDTAVYYCAT (SEQ ID NO: 500)

RATISRDKAKNSLYLQLNSLRAEDTAVYYCAT** (SEQ ID NO: 501)
RATISRDNAKSSAYMQMNSLRAEDTAVYYCAR (SEQ ID NO: 502)
RATISRDNAKSSAYLQLNSLRAEDTAVYYCAR (SEQ ID NO: 503)
RATISRDNAKSSAYLQMNSLRAEDTAVYYCAT (SEQ ID NO: 504)
RATISRDNAKSSLYMQLNSLRAEDTAVYYCAR (SEQ ID NO: 505)
RATISRDNAKSSLYMQMNSLRAEDTAVYYCAT (SEQ ID NO: 506)
RATISRDNAKSSLYLQLNSLRAEDTAVYYCAT (SEQ ID NO: 507)
RATISRDNAKNSAYMQLNSLRAEDTAVYYCAR (SEQ ID NO: 508)
RATISRDNAKNSAYMQMNSLRAEDTAVYYCAT (SEQ ID NO: 509)
RATISRDNAKNSAYLQLNSLRAEDTAVYYCAT (SEQ ID NO: 510)
RATISRDNAKNSLYMQLNSLRAEDTAVYYCAT (SEQ ID NO: 511)
RFTLSVDKAKSSLYLQMNSLRAEDTAVYYCAR (SEQ ID NO: 512)
RFTLSVDKAKNSAYLQMNSLRAEDTAVYYCAR (SEQ ID NO: 513)
RFTLSVDKAKNSLYMQMNSLRAEDTAVYYCAR (SEQ ID NO: 514)
RFTLSVDKAKNSLYLQLNSLRAEDTAVYYCAR (SEQ ID NO: 515)
RFTLSVDKAKNSLYLQMNSLRAEDTAVYYCAT (SEQ ID NO: 516)
RFTLSVDNAKSSAYLQMNSLRAEDTAVYYCAR (SEQ ID NO: 517)
RFTLSVDNAKSSLYMQMNSLRAEDTAVYYCAR (SEQ ID NO: 518)
RFTLSVDNAKSSLYLQLNSLRAEDTAVYYCAR (SEQ ID NO: 519)
RFTLSVDNAKSSLYLQMNSLRAEDTAVYYCAT (SEQ ID NO: 520)
RFTLSVDNAKNSAYMQMNSLRAEDTAVYYCAR (SEQ ID NO: 521)
RFTLSVDNAKNSAYLQLNSLRAEDTAVYYCAR (SEQ ID NO: 522)
RFTLSVDNAKNSAYLQMNSLRAEDTAVYYCAT (SEQ ID NO: 523)
RFTLSVDNAKNSLYMQLNSLRAEDTAVYYCAR (SEQ ID NO: 524)
RFTLSVDNAKNSLYMQMNSLRAEDTAVYYCAT (SEQ ID NO: 525)
RFTLSVDNAKNSLYLQLNSLRAEDTAVYYCAT (SEQ ID NO: 526)
RFTLSRDKASNSAYLQMNSLRAEDTAVYYCAR (SEQ ID NO: 527)
RFTLSRDKASNSLYMQMNSLRAEDTAVYYCAR (SEQ ID NO: 528)
RFTLSRDKASNSLYLQLNSLRAEDTAVYYCAR (SEQ ID NO: 529)
RFTLSRDKASNSLYLQLNSLRAEDTAVYYCAR (SEQ ID NO: 530)
RFTLSRDKAKNSAYMQMNSLRAEDTAVYYCAR (SEQ ID NO: 531)
RFTLSRDKAKNSAYLQMNSLRAEDTAVYYCAR (SEQ ID NO: 532)
RFTLSRDKAKNSAYLQMNSLRAEDTAVYYCAT (SEQ ID NO: 533)
RFTLSRDKAKNSLYMQLNSLRAEDTAVYYCAR (SEQ ID NO: 534)
RFTLSRDKAKNSLYMQMNSLRAEDTAVYYCAR (SEQ ID NO: 535)
RFTLSRDKAKNSLYLQLNSLRAEDTAVYYCAR (SEQ ID NO: 536)
RFTLSRDNAKSSAYMQMNSLRAEDTAVYYCAR (SEQ ID NO: 537)
RFTLSRDNAKSSAYLQLNSLRAEDTAVYYCAR (SEQ ID NO: 538)
RFTLSRDNAKSSAYLQMNSLRAEDTAVYYCAR (SEQ ID NO: 539)
RFTLSRDNAKSSLYMQLNSLRAEDTAVYYCAR (SEQ ID NO: 540)
RFTLSRDNAKSSLYMQMNSLRAEDTAVYYCAR (SEQ ID NO: 541)
RFTLSRDNAKSSLYMQMNSLRAEDTAVYYCAT (SEQ ID NO: 542)
RFTLSRDNAKSSLYLQLNSLRAEDTAVYYCAT (SEQ ID NO: 543)
RFTLSRDNAKNSAYMQMNSLRAEDTAVYYCAT (SEQ ID NO: 544)
RFTLSRDNAKNSAYLQLNSLRAEDTAVYYCAR (SEQ ID NO: 545)
RFTLSRDNAKNSLYMQLNSLRAEDTAVYYCAR (SEQ ID NO: 546)
RFTISVDKAKSSAYMQMNSLRAEDTAVYYCAR (SEQ ID NO: 547)
RFTISVDKAKSSLYMQMNSLRAEDTAVYYCAR (SEQ ID NO: 548)
RFTISVDKAKSSLYLQLNSLRAEDTAVYYCAR (SEQ ID NO: 549)
RFTISVDKAKSSLYLQMNSLRAEDTAVYYCAT (SEQ ID NO: 550)
RFTISVDKAKNSAYMQMNSLRAEDTAVYYCAR (SEQ ID NO: 551)
RFTISVDKAKNSAYLQMNSLRAEDTAVYYCAR (SEQ ID NO: 552)
RFTISVDKAKNSAYLQMNSLRAEDTAVYYCAR (SEQ ID NO: 553)
RFTISVDKAKNSLYMQLNSLRAEDTAVYYCAR (SEQ ID NO: 554)
RFTISVDKAKNSLYMQMNSLRAEDTAVYYCAR (SEQ ID NO: 555)
RFTISVDKAKNSLYLQLNSLRAEDTAVYYCAR (SEQ ID NO: 556)
RFTISVDNAKSSAYLQLNSLRAEDTAVYYCAR (SEQ ID NO: 557)
RFTISVDNAKSSAYLQMNSLRAEDTAVYYCAT (SEQ ID NO: 558)
RFTISVDNAKSSLYMQLNSLRAEDTAVYYCAR (SEQ ID NO: 559)
RFTISVDNAKSSLYLQLNSLRAEDTAVYYCAT (SEQ ID NO: 560)
RFTISVDNAKSSLYLQLNSLRAEDTAVYYCAT (SEQ ID NO: 561)
RFTISVDNAKNSAYMQLNSLRAEDTAVYYCAR (SEQ ID NO: 562)
RFTISVDNAKNSAYMQMNSLRAEDTAVYYCAT (SEQ ID NO: 563)
RFTISVDNAKNSAYLQLNSLRAEDTAVYYCAR (SEQ ID NO: 564)
RFTISVDNAKNSLYMQLNSLRAEDTAVYYCAR (SEQ ID NO: 565)
RFTISRDKAKSSAYLQL**NSLRAEDTAVYYCAR (SEQ ID NO: 566)
RFTISRDKAKSSAYLQL**NSLRAEDTAVYYCAR (SEQ ID NO: 567)
RFTISRDKAKSSLYMQL**NSLRAEDTAVYYCAR (SEQ ID NO: 568)
RFTISRDKAKSSLYM**QMNSLRAEDTAVYYCAR (SEQ ID NO: 569)
RFTISRDKAKSSLYM**QMNSLRAEDTAVYYCAR (SEQ ID NO: 570)
RFTISRDKAKSSLYLQLNSLRAEDTAVYYCAT** (SEQ ID NO: 571)
RFTISRDKAKNSAYMQL**NSLRAEDTAVYYCAR (SEQ ID NO: 572)
RFTISRDKAKNSAYMQMNSLRAEDTAVYYCAT** (SEQ ID NO: 573)
RFTISRDKAKNSLYMQLNSLRAEDTAVYYCAT (SEQ ID NO: 574)
RFTISRDKAKNSLYMQLNSLRAEDTAVYYCAT (SEQ ID NO: 575)
RFTISRDNAKSSAYMQLNSLRAEDTAVYYCAR (SEQ ID NO: 576)
RFTISRDNAKSSAYMQMNSLRAEDTAVYYCAT (SEQ ID NO: 577)

TABLE 6-continued

Amino Acid Sequences derived from Murine 76E1 Antibody.

```
RFTISRDNAKSSAYLQLNSLRAEDTAVYYCAT  (SEQ ID NO: 578)
RFTISRDNAKSSLYMQLNSLRAEDTAVYYCAT  (SEQ ID NO: 579)
RFTISRDNAKNSAYMQLNSLRAEDTAVYYCAT  (SEQ ID NO: 580)
RATLSVDKASNSLYLQMNSLRAEDTAVYYCAR  (SEQ ID NO: 581)
RATLSVDKAKNSAYLQMNSLRAEDTAVYYCAR  (SEQ ID NO: 582)
RATLSVDKAKNSLYMQMNSLRAEDTAVYYCAR  (SEQ ID NO: 583)
RATLSVDKAKNSLYLQLNSLRAEDTAVYYCAR  (SEQ ID NO: 584)
RATLSVDKAKNSLYLQMNSLRAEDTAVYYCAT  (SEQ ID NO: 585)
RATLSVDKAKNSSAYLQMNSLRAEDTAVYYCAR (SEQ ID NO: 586)
RATLSVDKAKNSSLYMQMNSLRAEDTAVYYCAT (SEQ ID NO: 587)
RATLSVDKAKNSSLYLQMNSLRAEDTAVYYCAR (SEQ ID NO: 588)
RATLSVDKAKNSSLYLQLNSLRAEDTAVYYCAT (SEQ ID NO: 589)
RATLSVDKAKNSAYMQMNSLRAEDTAVYYCAR  (SEQ ID NO: 590)
RATLSVDKAKNSAYLQLNSLRAEDTAVYYCAT  (SEQ ID NO: 591)
RATLSVDKAKNSAYLQMNSLRAEDTAVYYCAT  (SEQ ID NO: 592)
RATLSVDKAKNSLYMQLNSLRAEDTAVYYCAT  (SEQ ID NO: 593)
RATLSVDKAKNSLYMQMNSLRAEDTAVYYCAT  (SEQ ID NO: 594)
RATLSVDKAKNSLYLQMNSLRAEDTAVYYCAT  (SEQ ID NO: 595)
RATLSRDKAKSSAYLQMNSLRAEDTAVYYCAR  (SEQ ID NO: 596)
RATLSRDKAKSSLYMQMNSLRAEDTAVYYCAR  (SEQ ID NO: 597)
RATLSRDKAKSSLYLQLNSLRAEDTAVYYCAR  (SEQ ID NO: 598)
RATLSRDKAKSSLYLQLNSLRAEDTAVYYCAT  (SEQ ID NO: 599)
RATLSRDKAKNSAYMQMNSLRAEDTAVYYCAR  (SEQ ID NO: 600)
RATLSRDKAKNSAYLQLNSLRAEDTAVYYCAT  (SEQ ID NO: 601)
RATLSRDKAKNSAYLQMNSLRAEDTAVYYCAT  (SEQ ID NO: 602)
RATLSRDKAKNSLYMQLNSLRAEDTAVYYCAT  (SEQ ID NO: 603)
RATLSRDKAKNSLYMQMNSLRAEDTAVYYCAT  (SEQ ID NO: 604)
RATLSRDKAKNSLYLQMNSLRAEDTAVYYCAT  (SEQ ID NO: 605)
RATLSRDNAKSSAYMQMNSLRAEDTAVYYCAR  (SEQ ID NO: 606)
RATLSRDNAKSSAYMQMNSLRAEDTAVYYCAT  (SEQ ID NO: 607)
RATLSRDNAKSSLYMQLNSLRAEDTAVYYCAR  (SEQ ID NO: 608)
RATLSRDNAKSSLYMQLNSLRAEDTAVYYCAT  (SEQ ID NO: 609)
RATLSRDNAKSSLYMQMNSLRAEDTAVYYCAT  (SEQ ID NO: 610)
RATLSRDNAKSSLYLQLNSLRAEDTAVYYCAT  (SEQ ID NO: 611)
RATLSRDNAKSSLYLQMNSLRAEDTAVYYCAT  (SEQ ID NO: 612)
RATLSRDNAKNSAYMQLNSLRAEDTAVYYCAT  (SEQ ID NO: 613)
RATLSRDNAKNSAYLQLNSLRAEDTAVYYCAT  (SEQ ID NO: 614)
RATLSRDNAKNSLYMQLNSLRAEDTAVYYCAT  (SEQ ID NO: 615)
RATISVDKAKSSAYLQMNSLRAEDTAVYYCAR  (SEQ ID NO: 616)
RATISVDKAKSSLYMQMNSLRAEDTAVYYCAR  (SEQ ID NO: 617)
RATISVDKAKSSLYLQLNSLRAEDTAVYYCAT  (SEQ ID NO: 618)
RATISVDKAKSSLYLQMNSLRAEDTAVYYCAT  (SEQ ID NO: 619)
RATISVDKAKNSAYLQMNSLRAEDTAVYYCAR  (SEQ ID NO: 620)
RATISVDKAKNSAYLQMNSLRAEDTAVYYCAT  (SEQ ID NO: 621)
RATISVDKAKNSAYLQLNSLRAEDTAVYYCAT  (SEQ ID NO: 622)
RATISVDKAKNSLYMQMNSLRAEDTAVYYCAR  (SEQ ID NO: 623)
RATISVDKAKNSLYMQLNSLRAEDTAVYYCAR  (SEQ ID NO: 624)
RATISVDKAKNSLYLQMNSLRAEDTAVYYCAT  (SEQ ID NO: 625)
RATISVDNAKSSAYMQMNSLRAEDTAVYYCAR  (SEQ ID NO: 626)
RATISVDNAKSSAYLQMNSLRAEDTAVYYCAR  (SEQ ID NO: 627)
RATISVDNAKSSAYLQMNSLRAEDTAVYYCAT  (SEQ ID NO: 628)
RATISVDNAKSSLYMQLNSLRAEDTAVYYCAR  (SEQ ID NO: 629)
RATISVDNAKSSLYLQLNSLRAEDTAVYYCAT  (SEQ ID NO: 630)
RATISVDNAKSSLYLQLNSLRAEDTAVYYCAT  (SEQ ID NO: 631)
RATISVDNAKNSAYMQMNSLRAEDTAVYYCAR  (SEQ ID NO: 632)
RATISVDNAKNSAYMQMNSLRAEDTAVYYCAT  (SEQ ID NO: 633)
RATISVDNAKNSAYLQMNSLRAEDTAVYYCAT  (SEQ ID NO: 634)
RATISVDNAKNSLYMQLNSLRAEDTAVYYCAT  (SEQ ID NO: 635)
RATISRDKAKSSAYMQMNSLRAEDTAVYYCAR  (SEQ ID NO: 636)
RATISRDKAKSSAYLQMNSLRAEDTAVYYCAT  (SEQ ID NO: 637)
RATISRDKAKSSLYMQMNSLRAEDTAVYYCAT  (SEQ ID NO: 638)
RATISRDKAKSSLYMQMNSLRAEDTAVYYCAT  (SEQ ID NO: 639)
RATISRDKAKSSLYLQMNSLRAEDTAVYYCAR  (SEQ ID NO: 640)
RATISRDKAKNSAYMQMNSLRAEDTAVYYCAR  (SEQ ID NO: 641)
RATISRDKAKNSAYMQMNSLRAEDTAVYYCAR  (SEQ ID NO: 642)
RATISRDKAKNSAYMQMNSLRAEDTAVYYCAR  (SEQ ID NO: 643)
RATISRDKAKNSAYLQLNSLRAEDTAVYYCAT  (SEQ ID NO: 644)
RATISRDKAKNSLYMQMNSLRAEDTAVYYCAT  (SEQ ID NO: 645)
RATISRDNAKSSAYMQMNSLRAEDTAVYYCAT  (SEQ ID NO: 646)
RATISRDNAKSSAYLQMNSLRAEDTAVYYCAT  (SEQ ID NO: 647)
RATISRDNAKSSAYLQMNSLRAEDTAVYYCAT  (SEQ ID NO: 648)
RATISRDNAKSSLYLQMNSLRAEDTAVYYCAT  (SEQ ID NO: 649)
RATISRDNAKNSAYMQMNSLRAEDTAVYYCAT  (SEQ ID NO: 650)
RFTLSVDKAKSSAYLQMNSLRAEDTAVYYCAR  (SEQ ID NO: 651)
RFTLSVDKAKSSLYMQMNSLRAEDTAVYYCAR  (SEQ ID NO: 652)
RFTLSVDKAKSSLYLQLNSLRAEDTAVYYCAR  (SEQ ID NO: 653)
RFTLSVDKAKSSLYLQMNSLRAEDTAVYYCAT  (SEQ ID NO: 654)
RFTLSVDKAKNSAYMQMNSLRAEDTAVYYCAR  (SEQ ID NO: 655)
RFTLSVDKAKNSAYLQLNSLRAEDTAVYYCAR  (SEQ ID NO: 656)
RFTLSVDKAKNSAYLQLNSLRAEDTAVYYCAR  (SEQ ID NO: 657)
RFTLSVDKAKNSLYMQLNSLRAEDTAVYYCAR  (SEQ ID NO: 658)
RFTLSVDKAKNSLYMQMNSLRAEDTAVYYCAT  (SEQ ID NO: 659)
RFTLSVDKAKNSLYLQLNSLRAEDTAVYYCAT  (SEQ ID NO: 660)
RFTLSVDNAKSSAYMQMNSLRAEDTAVYYCAR  (SEQ ID NO: 661)
RFTLSVDNAKSSAYLQLNSLRAEDTAVYYCAR  (SEQ ID NO: 662)
RFTLSVDNAKSSAYLQMNSLRAEDTAVYYCAT  (SEQ ID NO: 663)
RFTLSVDNAKSSLYMQLNSLRAEDTAVYYCAT  (SEQ ID NO: 664)
RFTLSVDNAKSSLYMQMNSLRAEDTAVYYCAR  (SEQ ID NO: 665)
RFTLSVDNAKSSLYLQLNSLRAEDTAVYYCAT  (SEQ ID NO: 666)
RFTLSVDNAKNSAYMQLNSLRAEDTAVYYCAR  (SEQ ID NO: 667)
RFTLSVDNAKNSAYMQLNSLRAEDTAVYYCAT  (SEQ ID NO: 668)
RFTLSVDNAKNSAYLQLNSLRAEDTAVYYCAT  (SEQ ID NO: 669)
RFTLSVDNAKNSLYMQLNSLRAEDTAVYYCAT  (SEQ ID NO: 670)
RFTLSRDKASNSAYMQMNSLRAEDTAVYYCAR  (SEQ ID NO: 671)
RFTLSRDKASNSAYLQMNSLRAEDTAVYYCAR  (SEQ ID NO: 672)
RFTLSRDKASNSAYLQMNSLRAEDTAVYYCAT  (SEQ ID NO: 673)
RFTLSRDKASNSLYMQLNSLRAEDTAVYYCAR  (SEQ ID NO: 674)
RFTLSRDKASNSLYMQMNSLRAEDTAVYYCAT  (SEQ ID NO: 675)
RFTLSRDKASNSLYLQMNSLRAEDTAVYYCAR  (SEQ ID NO: 676)
RFTLSRDKAKNSAYMQMNSLRAEDTAVYYCAR  (SEQ ID NO: 677)
RFTLSRDKAKNSAYMQMNSLRAEDTAVYYCAR  (SEQ ID NO: 678)
RFTLSRDKAKNSAYLQMNSLRAEDTAVYYCAT  (SEQ ID NO: 679)
RFTLSRDKAKNSLYMQLNSLRAEDTAVYYCAR  (SEQ ID NO: 680)
RFTLSRDNAKSSAYMQMNSLRAEDTAVYYCAR  (SEQ ID NO: 681)
RFTLSRDNAKSSAYMQMNSLRAEDTAVYYCAR  (SEQ ID NO: 682)
RFTLSRDNAKSSAYLQMNSLRAEDTAVYYCAT  (SEQ ID NO: 683)
RFTLSRDNAKSSLYMQMNSLRAEDTAVYYCAR  (SEQ ID NO: 684)
RFTLSRDNAKNSAYMQMNSLRAEDTAVYYCAT  (SEQ ID NO: 685)
RFTISVDKAKSSAYMQMNSLRAEDTAVYYCAR  (SEQ ID NO: 686)
RFTISVDKAKSSAYLQLNSLRAEDTAVYYCAR  (SEQ ID NO: 687)
RFTISVDKAKSSAYLQMNSLRAEDTAVYYCAR  (SEQ ID NO: 688)
RFTISVDKAKSSLYMQMNSLRAEDTAVYYCAR  (SEQ ID NO: 689)
RFTISVDKAKSSLYMQMNSLRAEDTAVYYCAT  (SEQ ID NO: 690)
RFTISVDKAKSSLYLQMNSLRAEDTAVYYCAT  (SEQ ID NO: 691)
RFTISVDKAKNSAYMQLNSLRAEDTAVYYCAR  (SEQ ID NO: 692)
RFTISVDKAKNSAYMQMNSLRAEDTAVYYCAT  (SEQ ID NO: 693)
RFTISVDKAKNSAYLQMNSLRAEDTAVYYCAT  (SEQ ID NO: 694)
RFTISVDKAKNSLYMQLNSLRAEDTAVYYCAT  (SEQ ID NO: 695)
RFTISVDNAKSSAYLQLNSLRAEDTAVYYCAT  (SEQ ID NO: 696)
RFTISVDNAKSSLYMQMNSLRAEDTAVYYCAT  (SEQ ID NO: 697)
RFTISVDNAKNSAYMQLNSLRAEDTAVYYCAT  (SEQ ID NO: 698)
RFTISRDKAKSSAYMQMNSLRAEDTAVYYCAR  (SEQ ID NO: 699)
RFTISRDKAKSSAYMQMNSLRAEDTAVYYCAT  (SEQ ID NO: 700)
RFTISRDKAKSSAYLQMNSLRAEDTAVYYCAR  (SEQ ID NO: 701)
RFTISRDKAKSSLYMQMNSLRAEDTAVYYCAT  (SEQ ID NO: 702)
RFTISRDKAKNSAYMQMNSLRAEDTAVYYCAT  (SEQ ID NO: 703)
RFTISRDNAKSSAYMQMNSLRAEDTAVYYCAT  (SEQ ID NO: 704)
RATLSVDKASNSAYLQMNSLRAEDTAVYYCAR  (SEQ ID NO: 705)
RATLSVDKASNSLYMQMNSLRAEDTAVYYCAR  (SEQ ID NO: 706)
RATLSVDKASNSLYLQMNSLRAEDTAVYYCAT  (SEQ ID NO: 707)
RATLSVDKASNSLYLQMNSLRAEDTAVYYCAT  (SEQ ID NO: 708)
RATLSVDKAKNSAYMQMNSLRAEDTAVYYCAR  (SEQ ID NO: 709)
RATLSVDKAKNSAYLQLNSLRAEDTAVYYCAT  (SEQ ID NO: 710)
RATLSVDKAKNSAYLQMNSLRAEDTAVYYCAT  (SEQ ID NO: 711)
RATLSVDKAKNSLYMQMNSLRAEDTAVYYCAR  (SEQ ID NO: 712)
RATLSVDKAKNSLYMQMNSLRAEDTAVYYCAR  (SEQ ID NO: 713)
RATLSVDKAKNSLYLQLNSLRAEDTAVYYCAR  (SEQ ID NO: 714)
RATLSVDNAKSSAYMQMNSLRAEDTAVYYCAR  (SEQ ID NO: 715)
RATLSVDNAKSSAYLQLNSLRAEDTAVYYCAR  (SEQ ID NO: 716)
RATLSVDNAKSSAYLQMNSLRAEDTAVYYCAT  (SEQ ID NO: 717)
RATLSVDNAKSSLYMQMNSLRAEDTAVYYCAT  (SEQ ID NO: 718)
RATLSVDNAKSSLYMQMNSLRAEDTAVYYCAR  (SEQ ID NO: 719)
RATLSVDNAKSSLYLQMNSLRAEDTAVYYCAT  (SEQ ID NO: 720)
RATLSVDNAKNSAYMQMNSLRAEDTAVYYCAR  (SEQ ID NO: 721)
RATLSVDNAKNSAYMQMNSLRAEDTAVYYCAR  (SEQ ID NO: 722)
RATLSVDNAKNSAYLQMNSLRAEDTAVYYCAR  (SEQ ID NO: 723)
RATLSVDNAKNSLYMQMNSLRAEDTAVYYCAR  (SEQ ID NO: 724)
RATLSRDKAKSSAYMQMNSLRAEDTAVYYCAR  (SEQ ID NO: 725)
RATLSRDKAKSSAYMQMNSLRAEDTAVYYCAR  (SEQ ID NO: 726)
RATLSRDKAKSSAYLQMNSLRAEDTAVYYCAR  (SEQ ID NO: 727)
RATLSRDKAKSSLYMQMNSLRAEDTAVYYCAT  (SEQ ID NO: 728)
RATLSRDKAKSSLYMQMNSLRAEDTAVYYCAT  (SEQ ID NO: 729)
RATLSRDKAKSSLYLQLNSLRAEDTAVYYCAT  (SEQ ID NO: 730)
RATLSRDKAKNSAYMQMNSLRAEDTAVYYCAR  (SEQ ID NO: 731)
```

TABLE 6-continued

Amino Acid Sequences derived from Murine 76E1 Antibody.

RATLSRDKAKNSAYMQMNSLRAEDTAVYYCAT (SEQ ID NO: 732)
RATLSRDKAKNSAYLQLNSLRAEDTAVYYCAT (SEQ ID NO: 733)
RATLSRDKAKNSLYMQLNSLRAEDTAVYYCAT (SEQ ID NO: 734)
RATLSRDNAKSSAYMQLNSLRAEDTAVYYCAR (SEQ ID NO: 735)
RATLSRDNAKSSAYMQMNSLRAEDTAVYYCAT (SEQ ID NO: 736)
RATLSRDNAKSSAYLQLNSLRAEDTAVYYCAT (SEQ ID NO: 737)
RATLSRDNAKSSLYMQLNSLRAEDTAVYYCAT (SEQ ID NO: 738)
RATLSRDNAKNSAYMQLNSLRAEDTAVYYCAT (SEQ ID NO: 739)
RATISVDKAKSSAYMQLNSLRAEDTAVYYCAR (SEQ ID NO: 740)
RATISVDKAKSSAYLQLNSLRAEDTAVYYCAT (SEQ ID NO: 741)
RATISVDKAKSSAYLQMNSLRAEDTAVYYCAT (SEQ ID NO: 742)
RATISVDKAKSSLYMQLNSLRAEDTAVYYCAT (SEQ ID NO: 743)
RATISVDKAKSSLYMQMNSLRAEDTAVYYCAT (SEQ ID NO: 744)
RATISVDKAKSSLYLQLNSLRAEDTAVYYCAT (SEQ ID NO: 745)
RATISVDKAKNSAYMQLNSLRAEDTAVYYCAR (SEQ ID NO: 746)
RATISVDKAKNSAYMQMNSLRAEDTAVYYCAT (SEQ ID NO: 747)
RATISVDKAKNSAYLQLNSLRAEDTAVYYCAT (SEQ ID NO: 748)
RATISVDKAKNSLYMQLNSLRAEDTAVYYCAT (SEQ ID NO: 749)
RATISVDNAKSSAYMQLNSLRAEDTAVYYCAR (SEQ ID NO: 750)
RATISVDNAKSSAYMQMNSLRAEDTAVYYCAT (SEQ ID NO: 751)
RATISVDNAKSSAYLQLNSLRAEDTAVYYCAT (SEQ ID NO: 752)
RATISVDNAKSSLYMQLNSLRAEDTAVYYCAT (SEQ ID NO: 753)
RATISVDNAKNSAYMQLNSLRAEDTAVYYCAT (SEQ ID NO: 754)
RATISRDKAKSSAYMQLNSLRAEDTAVYYCAR (SEQ ID NO: 755)
RATISRDKAKSSAYMQMNSLRAEDTAVYYCAT (SEQ ID NO: 756)
RATISRDKAKSSAYLQLNSLRAEDTAVYYCAT (SEQ ID NO: 757)
RATISRDKAKSSLYMQLNSLRAEDTAVYYCAT (SEQ ID NO: 758)
RATISRDKAKNSAYMQLNSLRAEDTAVYYCAT (SEQ ID NO: 759)
RATISRDNAKSSAYMQLNSLRAEDTAVYYCAT (SEQ ID NO: 760)
RFTLSVDKAKSSAYMQLNSLRAEDTAVYYCAR (SEQ ID NO: 761)
RFTLSVDKAKSSAYLQLNSLRAEDTAVYYCAT (SEQ ID NO: 762)
RFTLSVDKAKSSAYLQMNSLRAEDTAVYYCAT (SEQ ID NO: 763)
RFTLSVDKAKSSLYMQLNSLRAEDTAVYYCAR (SEQ ID NO: 764)
RFTLSVDKAKSSLYMQLNSLRAEDTAVYYCAT (SEQ ID NO: 765)
RFTLSVDKAKSSLYLQLNSLRAEDTAVYYCAT (SEQ ID NO: 766)
RFTLSVDKAKNSAYMQLNSLRAEDTAVYYCAR (SEQ ID NO: 767)
RFTLSVDKAKNSAYMQMNSLRAEDTAVYYCAT (SEQ ID NO: 768)
RFTLSVDKAKNSAYLQLNSLRAEDTAVYYCAT (SEQ ID NO: 769)
RFTLSVDKAKNSLYMQLNSLRAEDTAVYYCAT (SEQ ID NO: 770)
RFTLSVDNAKSSAYMQLNSLRAEDTAVYYCAR (SEQ ID NO: 771)
RFTLSVDNAKSSAYMQMNSLRAEDTAVYYCAT (SEQ ID NO: 772)
RFTLSVDNAKSSAYLQLNSLRAEDTAVYYCAT (SEQ ID NO: 773)
RFTLSVDNAKSSLYMQLNSLRAEDTAVYYCAT (SEQ ID NO: 774)
RFTLSVDNAKNSAYMQLNSLRAEDTAVYYCAT (SEQ ID NO: 775)
RFTLSRDKASNSAYMQLNSLRAEDTAVYYCAR (SEQ ID NO: 776)
RFTLSRDKASNSAYMQLNSLRAEDTAVYYCAT (SEQ ID NO: 777)
RFTLSRDKASNSAYMQMNSLRAEDTAVYYCAT (SEQ ID NO: 778)
RFTLSRDKASNSAYLQLNSLRAEDTAVYYCAT (SEQ ID NO: 779)
RFTLSRDKAKNSAYMQLNSLRAEDTAVYYCAT (SEQ ID NO: 780)
RFTLSRDNAKSSAYMQLNSLRAEDTAVYYCAT (SEQ ID NO: 781)
RFTISVDKAKSSAYMQMNSLRAEDTAVYYCAR (SEQ ID NO: 782)
RFTISVDKAKSSAYMQMNSLRAEDTAVYYCAT (SEQ ID NO: 783)
RFTISVDKAKSSAYLQLNSLRAEDTAVYYCAT (SEQ ID NO: 784)
RFTISVDKAKSSLYMQLNSLRAEDTAVYYCAT (SEQ ID NO: 785)
RFTISVDKAKNSAYMQLNSLRAEDTAVYYCAT (SEQ ID NO: 786)
RFTISRDKAKSSAYMQLNSLRAEDTAVYYCAT (SEQ ID NO: 787)
RATLSVDKASNSAYMQMNSLRAEDTAVYYCAR (SEQ ID NO: 788)
RATLSVDKASNSAYLQLNSLRAEDTAVYYCAR (SEQ ID NO: 789)
RATLSVDKASNSAYLQMNSLRAEDTAVYYCAT (SEQ ID NO: 790)
RATLSVDKASNSLYMQMNSLRAEDTAVYYCAT (SEQ ID NO: 791)
RATLSVDKASNSLYMQMNSLRAEDTAVYYCAT (SEQ ID NO: 792)
RATLSVDKASNSLYLQLNSLRAEDTAVYYCAT (SEQ ID NO: 793)
RATLSVDKAKNSAYMQLNSLRAEDTAVYYCAR (SEQ ID NO: 794)
RATLSVDKAKNSAYMQMNSLRAEDTAVYYCAT (SEQ ID NO: 795)
RATLSVDKAKNSAYLQLNSLRAEDTAVYYCAT (SEQ ID NO: 796)
RATLSVDKAKNSLYMQLNSLRAEDTAVYYCAT (SEQ ID NO: 797)
RATLSVDNAKSSAYMQLNSLRAEDTAVYYCAR (SEQ ID NO: 798)
RATLSVDNAKSSAYMQMNSLRAEDTAVYYCAT (SEQ ID NO: 799)
RATLSVDNAKSSAYLQLNSLRAEDTAVYYCAT (SEQ ID NO: 800)
RATLSVDNAKSSLYMQLNSLRAEDTAVYYCAT (SEQ ID NO: 801)
RATLSVDNAKNSAYMQLNSLRAEDTAVYYCAT (SEQ ID NO: 802)
RATLSRDKAKSSAYMQMNSLRAEDTAVYYCAT (SEQ ID NO: 803)
RATLSRDKAKSSAYMQMNSLRAEDTAVYYCAT (SEQ ID NO: 804)
RATLSRDKAKSSAYLQLNSLRAEDTAVYYCAT (SEQ ID NO: 805)
RATLSRDKAKSSLYMQLNSLRAEDTAVYYCAT (SEQ ID NO: 806)
RATLSRDKAKNSAYMQLNSLRAEDTAVYYCAT (SEQ ID NO: 807)
RATLSRDNAKSSAYMQLNSLRAEDTAVYYCAT (SEQ ID NO: 808)

RATISVDKAKSSAYMQLNSLRAEDTAVYYCAR (SEQ ID NO: 809)
RATISVDKAKSSAYMQMNSLRAEDTAVYYCAT (SEQ ID NO: 810)
RATISVDKAKSSAYLQLNSLRAEDTAVYYCAT (SEQ ID NO: 811)
RATISVDKAKSSLYMQLNSLRAEDTAVYYCAT (SEQ ID NO: 812)
RATISVDKAKNSAYMQLNSLRAEDTAVYYCAT (SEQ ID NO: 813)
RATISVDNAKSSAYMQLNSLRAEDTAVYYCAT (SEQ ID NO: 814)
RATISRDKAKSSAYMQLNSLRAEDTAVYYCAT (SEQ ID NO: 815)
RFTLSVDKAKSSAYMQLNSLRAEDTAVYYCAR (SEQ ID NO: 816)
RFTLSVDKAKSSAYMQMNSLRAEDTAVYYCAT (SEQ ID NO: 817)
RFTLSVDKAKSSAYLQLNSLRAEDTAVYYCAT (SEQ ID NO: 818)
RFTLSVDKAKSSLYMQLNSLRAEDTAVYYCAT (SEQ ID NO: 819)
RFTLSVDKAKNSAYMQLNSLRAEDTAVYYCAT (SEQ ID NO: 820)
RFTLSVDNAKSSAYMQLNSLRAEDTAVYYCAT (SEQ ID NO: 821)
RFTLSRDKASNSAYMQLNSLRAEDTAVYYCAT (SEQ ID NO: 822)
RFTISVDKAKSSAYMQLNSLRAEDTAVYYCAT (SEQ ID NO: 823)
RATLSVDKASNSAYMQLNSLRAEDTAVYYCAR (SEQ ID NO: 824)
RATLSVDKASNSAYMQMNSLRAEDTAVYYCAT (SEQ ID NO: 825)
RATLSVDKASNSAYLQLNSLRAEDTAVYYCAT (SEQ ID NO: 826)
RATLSVDKASNSLYMQLNSLRAEDTAVYYCAT (SEQ ID NO: 827)
RATLSVDKAKNSAYMQLNSLRAEDTAVYYCAT (SEQ ID NO: 828)
RATLSVDNAKSSAYMQLNSLRAEDTAVYYCAT (SEQ ID NO: 829)
RATLSRDKAKSSAYMQLNSLRAEDTAVYYCAT (SEQ ID NO: 830)
RATISVDKAKSSAYMQLNSLRAEDTAVYYCAT (SEQ ID NO: 831)
RFTLSVDKAKSSAYMQLNSLRAEDTAVYYCAT (SEQ ID NO: 832)
RATLSVDKASNSAYMQLNSLRAEDTAVYYCAT (SEQ ID NO: 833)

76E1-huVH3b VH CDR3
STMITPFDY (SEQ ID NO: 32)
STLITPFDY (SEQ ID NO: 319)

76E1-huVH3b VH FR4
WGQGTLVTVSS (SEQ ID NO: 54)
WGQGTLLTVSS (SEQ ID NO: 320)

76E1 HUMANIZED ANTIBODY SEQUENCE: LIGHT CHAIN
76E1-huVK2 Variable Region
DIVMTQSPLSLPVTPGEPASISCRSSQSIVHSNGNTYLEWYLQKPGQSPQ
LLIYKVSNRFSGVPDRFSGSGSGTDFTLKISRVEAEDVGVYYCFQGSHVP
WTFGQGTKLEIK (SEQ ID NO: 24)

76E1-huVK2 VL FR1
DIVMTQSPLSLPVTPGEPASISC (SEQ ID NO: 75)
DVVMTQSPLSLPVTPGEPASISC (SEQ ID NO: 252)

76E1-huVK2 VL CDR1
RSSQSIVHSNGNTYLE (SEQ ID NO: 45)
RSSQSIVHSQGNTYLE (SEQ ID NO: 253)
RSSQSIVHSSGNTYLE (SEQ ID NO: 254)
RSSQSIVHSAGNTYLE (SEQ ID NO: 255)
RSSQSIVHSNGQTYLE (SEQ ID NO: 256)
RSSQSIVHSNGSTYLE (SEQ ID NO: 257)
RSSQSIVHSNGATYLE (SEQ ID NO: 258)
RSSQSIVHSNGDTYLE (SEQ ID NO: 259)
RSSQSIVHSQGQTYLE (SEQ ID NO: 260)
RSSQSIVHSQGSTYLE (SEQ ID NO: 261)
RSSQSIVHSQGATYLE (SEQ ID NO: 262)
RSSQSIVHSQGDTYLE (SEQ ID NO: 263)
RSSQSIVHSSGQTYLE (SEQ ID NO: 264)
RSSQSIVHSSGSTYLE (SEQ ID NO: 265)
RSSQSIVHSSGATYLE (SEQ ID NO: 266)
RSSQSIVHSSGDTYLE (SEQ ID NO: 267)
RSSQSIVHSAGQTYLE (SEQ ID NO: 268)
RSSQSIVHSAGSTYLE (SEQ ID NO: 269)
RSSQSIVHSAGATYLE (SEQ ID NO: 270)
RSSQSIVHSAGDTYLE (SEQ ID NO: 271)

76E1-huVK2 VL FR2
WYLQKPGQSPQLLIY (SEQ ID NO: 76)

76E1-huVK2 VL CDR2
KVSNRFS (SEQ ID NO: 40)
KVSQRFS (SEQ ID NO: 843)
KVSSRFS (SEQ ID NO: 844)
KVSDRFS (SEQ ID NO: 845)
KVSARFS (SEQ ID NO: 846)

TABLE 6-continued

Amino Acid Sequences derived from Murine 76E1 Antibody.

76E1-huVK2 VL FR3
GVPDRFSGSGSGTDFTLKISRVEAEDVGVYYC (SEQ ID NO: 77)
GVPDRFSGSGSGTDFTLKISRVEAEDLGVYYC (SEQ ID NO: 276)

76E1-huVK2 VL CDR3
FQGSHVPWT (SEQ ID NO: 41)

76E1-huVK2 VL FR4
FGQGTKLEIK (SEQ ID NO: 78)

76E1-huVK1 Variable Region
DIQMTQSPSSLSASVGDRVTITCRSSQSIVHSNGNTYLEWYQQKPGKAPK
LLIYKVSNRFSGVPSRFSGSGSGTDFTLTISSLQPEDFATYYCFQGSHVP
WTFGQGTKLEIK (SEQ ID NO: 25)

76E1-huVK1 VL FR1
DIQMTQSPSSLSASVGDRVTITC (SEQ ID NO: 79)
DVQMTQSPSSLSASVGDRVTITC (SEQ ID NO: 277)
DIQMTQSPSSLSVSVGDRVTITC (SEQ ID NO: 278)
DIQMTQSPSSLSASVGDRATITC (SEQ ID NO: 279)
DVQMTQSPSSLSVSVGDRVTITC (SEQ ID NO: 280)
DVQMTQSPSSLSASVGDRATITC (SEQ ID NO: 281)
DIQMTQSPSSLSVSVGDRATITC (SEQ ID NO: 282)
DVQMTQSPSSLSVSVGDRATITC (SEQ ID NO: 283)

76E1-huVK1 VL CDR1
RSSQSIVHSNGNTYLE (SEQ ID NO: 45)
RSSQSIVHSQGNTYLE (SEQ ID NO: 253)
RSSQSIVHSSGNTYLE (SEQ ID NO: 254)
RSSQSIVHSAGNTYLE (SEQ ID NO: 255)
RSSQSIVHSNGQTYLE (SEQ ID NO: 256)
RSSQSIVHSNGSTYLE (SEQ ID NO: 257)
RSSQSIVHSNGATYLE (SEQ ID NO: 258)
RSSQSIVHSNGDTYLE (SEQ ID NO: 259)
RSSQSIVHSQGQTYLE (SEQ ID NO: 260)
RSSQSIVHSQGSTYLE (SEQ ID NO: 261)
RSSQSIVHSQGATYLE (SEQ ID NO: 262)
RSSQSIVHSQGDTYLE (SEQ ID NO: 263)
RSSQSIVHSSGQTYLE (SEQ ID NO: 264)
RSSQSIVHSSGSTYLE (SEQ ID NO: 265)
RSSQSIVHSSGATYLE (SEQ ID NO: 266)
RSSQSIVHSSGDTYLE (SEQ ID NO: 267)
RSSQSIVHSAGQTYLE (SEQ ID NO: 268)
RSSQSIVHSAGSTYLE (SEQ ID NO: 269)
RSSQSIVHSAGATYLE (SEQ ID NO: 270)
RSSQSIVHSAGDTYLE (SEQ ID NO: 271)

76E1-huVK1 VL FR2
WYQQKPGKAPKLLIY (SEQ ID NO: 80)
WYQQKPGKSPKLLIY (SEQ ID NO: 284)

76E1-huVK1 VL CDR2
KVSNRFS (SEQ ID NO: 40)
KVSQRFS (SEQ ID NO: 843)
KVSSRFS (SEQ ID NO: 844)
KVSDRFS (SEQ ID NO: 845)
KVSARFS (SEQ ID NO: 846)

76E1-huVK1 VL FR3
GVPSRFSGSGSGTDFTLTISSLQPEDFATYYC (SEQ ID NO: 81)
GVPSRFSGSGSGTDFTLTISSVQPEDFATYYC (SEQ ID NO: 285)
GVPSRFSGSGSGTDFTLTISSLQPEDLATYYC (SEQ ID NO: 286)
GVPSRFSGSGSGTDFTLTISSLQPEDFGTYYC (SEQ ID NO: 287)
GVPSRFSGSGSGTDFTLTISSVQPEDLATYYC (SEQ ID NO: 288)
GVPSRFSGSGSGTDFTLTISSVQPEDFGTYYC (SEQ ID NO: 289)
GVPSRFSGSGSGTDFTLTISSLQPEDLGTYYC (SEQ ID NO: 290)
GVPSRFSGSGSGTDFTLTISSVQPEDLGTYYC (SEQ ID NO: 291)

76E1-huVK1 VL CDR3
FQGSHVPWT (SEQ ID NO: 41)

TABLE 6-continued

Amino Acid Sequences derived from Murine 76E1 Antibody.

76E1-huVK1 VL FR4
FGQGTKLEIK (SEQ ID NO: 78)

* Amino acid position numbering as in Kabat.

TABLE 7

Amino Acid Sequences derived from Murine 141A Antibody.

141A HUMANIZED ANTIBODY SEQUENCE: HEAVY CHAIN
141A-huVH1a Variable Region
QVQLVQSGAEVKKPGASVKVSCKASGYTFSRYWIEVWRQAPGQGLEWMGE
ILPGSGSTNYNEKFKGRVTMTTDTSTSTAYMELRSLRSDDTAVYYCAR**EE
VYDGYPWFGY**WGQGTLVTVSS (SEQ ID NO: 16)

141A-huVH1a VH FR1
QVQLVQSGAEVKKPGASVKVSCKAS (SEQ ID NO: 51)
QVQLVQSGAEVMKPGASVKVSCKAS (SEQ ID NO: 39)
QVQLVQSGAEVKKPGASVKISCKAS (SEQ ID NO: 105)
QVQLVQSGAEVMKPGASVKISCKAS (SEQ ID NO: 58)

141A-huVH1a VH CDR1
GYTFSRYWIE (SEQ ID NO: 33)

141A-huVH1a VH FR2
WVRQAPGQGLEWMG (SEQ ID NO: 52)
WVRQAPGQGLEWIG (SEQ ID NO: 106)

141A-huVH1a VH CDR2
EILPGSGSTNYNEKFKG (SEQ ID NO: 34)
EILPGSGSTQYNEKFKG (SEQ ID NO: 847)
EILPGSGSTSYNEKFKG (SEQ ID NO: 848)
EILPGSGSTDYNEKFKG (SEQ ID NO: 849)
EILPGSGSTAYNEKFKG (SEQ ID NO: 850)
EILPGSGSTNYQEKFKG (SEQ ID NO: 851)
EILPGSGSTNYSEKFKG (SEQ ID NO: 852)
EILPGSGSTNYDEKFKG (SEQ ID NO: 853)
EILPGSGSTNYAEKFKG (SEQ ID NO: 854)
EILPGSGSTQYQEKFKG (SEQ ID NO: 855)
EILPGSGSTSYSEKFKG (SEQ ID NO: 856)
EILPGSGSTDYDEKFKG (SEQ ID NO: 857)
EILPGSGSTAYAEKFKG (SEQ ID NO: 858)

141A-huVH1a VH FR3
RVTMTTDTSTSTAYMELRSLRSDDTAVYYCAR (SEQ ID NO: 53)
RATMTTDTSTSTAYMELRSLRSDDTAVYYCAR (SEQ ID NO: 107)
RVTFTTDTSTSTAYMELRSLRSDDTAVYYCAR (SEQ ID NO: 108)
RVTMADTSTSTAYMELRSLRSDDTAVYYCAR (SEQ ID NO: 109)
RVTMTTDTNTSTAYMELRSLRSDDTAVYYCAR (SEQ ID NO: 859)
RVTMTTDTSTSTAYMELRSLRSDDTAVYYCAG (SEQ ID NO: 860)
RATFTTDTSTSTAYMELRSLRSDDTAVYYCAR (SEQ ID NO: 110)
RATMADTSTSTAYMELRSLRSDDTAVYYCAR (SEQ ID NO: 112)
RATMTTDTNTSTAYMELRSLRSDDTAVYYCAR (SEQ ID NO: 861)
RATMTTDTSTSTAYMELRSLRSDDTAVYYCAG (SEQ ID NO: 862)
RVTFTADTSTSTAYMELRSLRSDDTAVYYCAR (SEQ ID NO: 111)
RVTFTTDTNTSTAYMELRSLRSDDTAVYYCAR (SEQ ID NO: 863)
RVTFTTDTSTSTAYMELRSLRSDDTAVYYCAG (SEQ ID NO: 864)
RVTMADTNTSTAYMELRSLRSDDTAVYYCAR (SEQ ID NO: 865)
RVTMADTSTSTAYMELRSLRSDDTAVYYCAG (SEQ ID NO: 866)
RVTMTTDTNTSTAYMELRSLRSDDTAVYYCAG (SEQ ID NO: 867)
RATFTADTSTSTAYMELRSLRSDDTAVYYCAR (SEQ ID NO: 113)
RATFTTDTNTSTAYMELRSLRSDDTAVYYCAR (SEQ ID NO: 868)
RATFTTDTSTSTAYMELRSLRSDDTAVYYCAG (SEQ ID NO: 869)
RATMADTNTSTAYMELRSLRSDDTAVYYCAR (SEQ ID NO: 870)
RATMADTSTSTAYMELRSLRSDDTAVYYCAG (SEQ ID NO: 871)
RATMTTDTNTSTAYMELRSLRSDDTAVYYCAG (SEQ ID NO: 872)
RVTFTADTNTSTAYMELRSLRSDDTAVYYCAR (SEQ ID NO: 873)
RVTFTADTSTSTAYMELRSLRSDDTAVYYCAG (SEQ ID NO: 874)
RVTFTTDTNTSTAYMELRSLRSDDTAVYYCAG (SEQ ID NO: 875)
RVTMADTNTSTAYMELRSLRSDDTAVYYCAG (SEQ ID NO: 876)
RATFTADTNTSTAYMELRSLRSDDTAVYYCAR (SEQ ID NO: 877)
RATFTADTSTSTAYMELRSLRSDDTAVYYCAG (SEQ ID NO: 878)
RATFTTDTNTSTAYMELRSLRSDDTAVYYCAG (SEQ ID NO: 879)

TABLE 7-continued

Amino Acid Sequences derived from Murine 141A Antibody.

R<u>A</u>TMT<u>A</u>DT<u>N</u>TSTAYMELRSLRSDDTAVYYCA<u>G</u> (SEQ ID NO: 880)
RVT<u>F</u>T<u>A</u>DT<u>N</u>TSTAYMELRSLRSDDTAVYYCA<u>G</u> (SEQ ID NO: 881)
R<u>A</u>T<u>F</u>T<u>A</u>DT<u>N</u>TSTAYMELRSLRSDDTAVYYCA<u>G</u> (SEQ ID NO: 882)

141A-huVH1a VH CDR3
EEVYDGYPWFGY (SEQ ID NO: 35)
EEVY<u>E</u>GYPWFGY (SEQ ID NO: 883)
EEVY<u>S</u>GYPWFGY (SEQ ID NO: 884)
EEVY<u>A</u>GYPWFGY (SEQ ID NO: 885)

141A-huVH1a VH FR4
WGQGTLVTVSS (SEQ ID NO: 54)

141A-huVH1b Variable Region
QVQLVQSGAEVKKPGASVKVSCKASGYTFSRYWIEWVRQAPGQGLEWMG
EILPGSGSTNYAQKLQGRVTMTTDTSTSTAYMELRSLRSDDTAVYYCAR
EEVYDGYPWFGYWGQGTLVTVSS (SEQ ID NO: 17)

141A-huVH1b VH FR1
QVQLVQSGAEVKKPGASVKVSCKAS (SEQ ID NO: 51)
QVQLVQSGAEV<u>M</u>KPGASVKVSCKAS (SEQ ID NO: 39)
QVQLVQSGAEVKKPGASVK<u>I</u>SCKAS (SEQ ID NO: 105)
QVQLVQSGAEV<u>M</u>KPGASVK<u>I</u>SCKAS (SEQ ID NO: 58)

141A-huVH1b VH CDR1
GYTFSRYWIE (SEQ ID NO: 33)

141A-huVH1b VH FR2
WVRQAPGQGLEWMG (SEQ ID NO: 52)
WVRQAPGQGLEW<u>I</u>G (SEQ ID NO: 106)

141A-huVH1b VH CDR2*
EILPGSGSTNYAQKLQG (SEQ ID NO: 49)
EILPGSGST<u>Q</u>YAQKLQG (SEQ ID NO: 886)
EILPGSGST<u>S</u>YAQKLQG (SEQ ID NO: 887)
EILPGSGST<u>D</u>YAQKLQG (SEQ ID NO: 888)
EILPGSGST<u>A</u>YAQKLQG (SEQ ID NO: 889)
EILPGSGSTNYAQK<u>F</u>QG (SEQ ID NO: 890)
EILPGSGST<u>Q</u>YAQK<u>F</u>QG (SEQ ID NO: 891)
EILPGSGST<u>S</u>YAQK<u>F</u>QG (SEQ ID NO: 892)
EILPGSGST<u>D</u>YAQK<u>F</u>QG (SEQ ID NO: 893)
EILPGSGST<u>A</u>YAQK<u>F</u>QG (SEQ ID NO: 894)

141A-huVH1b VH FR3
RVTMTTDTSTSTAYMELRSLRSDDTAVYYCAR (SEQ ID NO: 53)
R<u>A</u>TMTTDTSTSTAYMELRSLRSDDTAVYYCAR (SEQ ID NO: 107)
RVT<u>F</u>TTDTSTSTAYMELRSLRSDDTAVYYCAR (SEQ ID NO: 108)
RVTM<u>A</u>DTSTSTAYMELRSLRSDDTAVYYCAR (SEQ ID NO: 109)
RVTMTTDT<u>N</u>TSTAYMELRSLRSDDTAVYYCAR (SEQ ID NO: 859)
RVTMTTDTSTSTAYMELRSLRSDDTAVYYCA<u>G</u> (SEQ ID NO: 860)
R<u>A</u>T<u>F</u>TTDTSTSTAYMELRSLRSDDTAVYYCAR (SEQ ID NO: 110)
R<u>A</u>TM<u>A</u>DTSTSTAYMELRSLRSDDTAVYYCAR (SEQ ID NO: 112)
R<u>A</u>TMTTDT<u>A</u>TSTAYMELRSLRSDDTAVYYCAR (SEQ ID NO: 861)
R<u>A</u>TMTTDTSTSTAYMELRSLRSDDTAVYYCA<u>G</u> (SEQ ID NO: 862)
RVT<u>F</u>T<u>A</u>DTSTSTAYMELRSLRSDDTAVYYCAR (SEQ ID NO: 111)
RVT<u>F</u>TTDT<u>N</u>TSTAYMELRSLRSDDTAVYYCAR (SEQ ID NO: 863)
RVT<u>F</u>TTDTSTSTAYMELRSLRSDDTAVYYCA<u>G</u> (SEQ ID NO: 864)
RVTM<u>A</u>DT<u>N</u>TSTAYMELRSLRSDDTAVYYCAR (SEQ ID NO: 865)
RVTM<u>A</u>DTSTSTAYMELRSLRSDDTAVYYCA<u>G</u> (SEQ ID NO: 866)
RVTMTTDT<u>N</u>TSTAYMELRSLRSDDTAVYYCA<u>G</u> (SEQ ID NO: 867)
R<u>A</u>T<u>F</u>T<u>A</u>DTSTSTAYMELRSLRSDDTAVYYCAR (SEQ ID NO: 113)
R<u>A</u>T<u>F</u>TTDT<u>N</u>TSTAYMELRSLRSDDTAVYYCAR (SEQ ID NO: 868)
R<u>A</u>T<u>F</u>TTDTSTSTAYMELRSLRSDDTAVYYCA<u>G</u> (SEQ ID NO: 869)
R<u>A</u>TM<u>A</u>DT<u>N</u>TSTAYMELRSLRSDDTAVYYCAR (SEQ ID NO: 870)
R<u>A</u>TM<u>A</u>DTSTSTAYMELRSLRSDDTAVYYCA<u>G</u> (SEQ ID NO: 871)
R<u>A</u>TMTTDT<u>N</u>TSTAYMELRSLRSDDTAVYYCA<u>G</u> (SEQ ID NO: 872)
RVT<u>F</u>T<u>A</u>DT<u>N</u>TSTAYMELRSLRSDDTAVYYCAR (SEQ ID NO: 873)
RVT<u>F</u>T<u>A</u>DTSTSTAYMELRSLRSDDTAVYYCA<u>G</u> (SEQ ID NO: 874)
RVT<u>F</u>TTDT<u>N</u>TSTAYMELRSLRSDDTAVYYCA<u>G</u> (SEQ ID NO: 875)
RVTM<u>A</u>DT<u>N</u>TSTAYMELRSLRSDDTAVYYCA<u>G</u> (SEQ ID NO: 876)
R<u>A</u>T<u>F</u>T<u>A</u>DT<u>N</u>TSTAYMELRSLRSDDTAVYYCAR (SEQ ID NO: 877)
R<u>A</u>T<u>F</u>T<u>A</u>DTSTSTAYMELRSLRSDDTAVYYCA<u>G</u> (SEQ ID NO: 878)
R<u>A</u>T<u>F</u>TTDT<u>N</u>TSTAYMELRSLRSDDTAVYYCA<u>G</u> (SEQ ID NO: 879)
R<u>A</u>TM<u>A</u>DT<u>N</u>TSTAYMELRSLRSDDTAVYYCA<u>G</u> (SEQ ID NO: 880)
RVT<u>F</u>T<u>A</u>DT<u>N</u>TSTAYMELRSLRSDDTAVYYCA<u>G</u> (SEQ ID NO: 881)
R<u>A</u>T<u>F</u>T<u>A</u>DT<u>N</u>TSTAYMELRSLRSDDTAVYYCA<u>G</u> (SEQ ID NO: 882)

141A-huVH1b VH CDR3
EEVYDGYPWFGY (SEQ ID NO: 35)

141A-huVH1b VH FR4
WGQGTLVTVSS (SEQ ID NO: 54)

141A-huVH3a Variable Region
EVQLVESGGGLVQPGGSLRLSCAASGYTFSRYWIEWVRQAPGKGLEWVS
EILPGSGSTNYNEKFKGRFTISRDNAKNSLYLQMNSLRAEDTAVYYCAR
EEVYDGYPWFGYWGQGTLVTVSS (SEQ ID NO: 18)

141A-huVH3a VH FR1
EVQLVESGGGLVQPGGSLRLSCAAS (SEQ ID NO: 55)
EVQLV<u>Q</u>SGGGLVQPGGSLRLSCAAS (SEQ ID NO: 115)
EVQLVESGGGLVQPGGS<u>V</u>RLSCAAS (SEQ ID NO: 116)
EVQLVESGGGLVQPGGSLR<u>I</u>SCAAS (SEQ ID NO: 117)
EVQLV<u>Q</u>SGGGLVQPGGS<u>V</u>RLSCAAS (SEQ ID NO: 118)
EVQLVESGGGLVQPGGS<u>VRI</u>SCAAS (SEQ ID NO: 119)
EVQLV<u>Q</u>SGGGLVQPGGSLR<u>I</u>SCAAS (SEQ ID NO: 120)
EVQLV<u>Q</u>SGGGLVQPGGS<u>VRI</u>SCAAS (SEQ ID NO: 121)
EVQLVESGGGL<u>MQ</u>PGGSLRLSCAAS (SEQ ID NO: 895)
EVQLV<u>Q</u>SGGGL<u>MQ</u>PGGS<u>V</u>RLSCAAS (SEQ ID NO: 896)
EVQLVESGGGL<u>MQ</u>PGGS<u>V</u>RLSCAAS (SEQ ID NO: 897)
EVQLVESGGGL<u>MQ</u>PGGSLR<u>I</u>SCAAS (SEQ ID NO: 898)
EVQLV<u>Q</u>SGGGL<u>MQ</u>PGGS<u>V</u>RLSCAAS (SEQ ID NO: 899)
EVQLVESGGGL<u>MQ</u>PGGSLR<u>I</u>SCAAS (SEQ ID NO: 900)
EVQLV<u>Q</u>SGGGL<u>MQ</u>PGGS<u>VRI</u>SCAAS (SEQ ID NO: 901)
EVQLV<u>Q</u>SGGGL<u>MQ</u>PGGS<u>VRI</u>SCAAS (SEQ ID NO: 902)

141A-huVH3a VH CDR1
GYTFSRYWIE (SEQ ID NO: 33)

141A-huVH3a VH FR2
WVRQAPGKGLEWVS (SEQ ID NO: 56)
WVRQAPGKGLEW<u>IS</u> (SEQ ID NO: 122)
WVRQAPGKGLEWV<u>G</u> (SEQ ID NO: 123)
WVRQAPGKGLEW<u>IG</u> (SEQ ID NO: 124)

141A-huVH3a VH CDR2
EILPGSGSTNYNEKFKG (SEQ ID NO: 34)
EILPGSGST<u>Q</u>YNEKFKG (SEQ ID NO: 847)
EILPGSGST<u>S</u>YNEKFKG (SEQ ID NO: 848)
EILPGSGST<u>D</u>YNEKFKG (SEQ ID NO: 849)
EILPGSGST<u>A</u>YNEKFKG (SEQ ID NO: 850)
EILPGSGSTNY<u>Q</u>EKFKG (SEQ ID NO: 851)
EILPGSGSTNY<u>S</u>EKFKG (SEQ ID NO: 852)
EILPGSGSTNY<u>D</u>EKFKG (SEQ ID NO: 853)
EILPGSGSTNY<u>A</u>EKFKG (SEQ ID NO: 854)
EILPGSGST<u>Q</u>Y<u>Q</u>EKFKG (SEQ ID NO: 855)
EILPGSGST<u>S</u>Y<u>S</u>EKFKG (SEQ ID NO: 856)
EILPGSGST<u>D</u>Y<u>D</u>EKFKG (SEQ ID NO: 857)
EILPGSGST<u>A</u>Y<u>A</u>EKFKG (SEQ ID NO: 858)

141A-huVH3a VH FR3
RFTISRDNAKNSLYLQMNSLRAEDTAVYYCAR (SEQ ID NO: 57)
R<u>A</u>TISRDNAKNSLYLQMNSLRAEDTAVYYCAR (SEQ ID NO: 125)
RFT<u>F</u>SRDNAKNSLYLQMNSLRAEDTAVYYCAR (SEQ ID NO: 126)
RFTIS<u>A</u>DNAKNSLYLQMNSLRAEDTAVYYCAR (SEQ ID NO: 127)
RFTISRD<u>T</u>AKNSLYLQMNSLRAEDTAVYYCAR (SEQ ID NO: 128)
RFTISRDNAKNS<u>A</u>YLQMNSLRAEDTAVYYCAR (SEQ ID NO: 129)
RFTISRDNAKNSLY<u>M</u>QMNSLRAEDTAVYYCAR (SEQ ID NO: 130)
RFTISRDNAKNSLYLQ<u>L</u>NSLRAEDTAVYYCAR (SEQ ID NO: 131)
R<u>A</u>T<u>F</u>SRDNAKNSLYLQMNSLRAEDTAVYYCAR (SEQ ID NO: 132)
R<u>A</u>TIS<u>A</u>DNAKNSLYLQMNSLRAEDTAVYYCAR (SEQ ID NO: 133)
R<u>A</u>TISRD<u>T</u>AKNSLYLQMNSLRAEDTAVYYCAR (SEQ ID NO: 134)
R<u>A</u>TISRDNAKNS<u>A</u>YLQMNSLRAEDTAVYYCAR (SEQ ID NO: 135)
R<u>A</u>TISRDNAKNSLY<u>M</u>QMNSLRAEDTAVYYCAR (SEQ ID NO: 136)
R<u>A</u>TISRDNAKNSLYLQ<u>L</u>NSLRAEDTAVYYCAR (SEQ ID NO: 137)
RFT<u>F</u>S<u>A</u>DNAKNSLYLQMNSLRAEDTAVYYCAR (SEQ ID NO: 138)
RFT<u>F</u>SRD<u>T</u>AKNSLYLQMNSLRAEDTAVYYCAR (SEQ ID NO: 139)
RFT<u>F</u>SRDNAKNS<u>A</u>YLQMNSLRAEDTAVYYCAR (SEQ ID NO: 140)
RFT<u>F</u>SRDNAKNSLY<u>M</u>QMNSLRAEDTAVYYCAR (SEQ ID NO: 141)
RFT<u>F</u>SRDNAKNSLYLQ<u>L</u>NSLRAEDTAVYYCAR (SEQ ID NO: 142)
RFTIS<u>A</u>D<u>T</u>AKNSLYLQMNSLRAEDTAVYYCAR (SEQ ID NO: 143)
RFTIS<u>A</u>DNAKNS<u>A</u>YLQMNSLRAEDTAVYYCAR (SEQ ID NO: 144)
RFTIS<u>A</u>DNAKNSLY<u>M</u>QMNSLRAEDTAVYYCAR (SEQ ID NO: 145)
RFTIS<u>A</u>DNAKNSLYLQ<u>L</u>NSLRAEDTAVYYCAR (SEQ ID NO: 146)

TABLE 7-continued

Amino Acid Sequences derived from Murine 141A Antibody.

```
RFTISRDTAKNSAYLQMNSLRAEDTAVYYCAR   (SEQ ID NO: 147)
RFTISRDTAKNSLYMQMNSLRAEDTAVYYCAR   (SEQ ID NO: 148)
RFTISRDTAKNSLYLQLNSLRAEDTAVYYCAR   (SEQ ID NO: 149)
RFTISRDNAKNSAYMQMNSLRAEDTAVYYCAR   (SEQ ID NO: 150)
RFTISRDNAKNSAYLQLNSLRAEDTAVYYCAR   (SEQ ID NO: 151)
RFTISRDNAKNSLYMQLNSLRAEDTAVYYCAR   (SEQ ID NO: 152)
RATFSADNAKNSLYLQMNSLRAEDTAVYYCAR   (SEQ ID NO: 153)
RATFSRDTAKNSLYLQMNSLRAEDTAVYYCAR   (SEQ ID NO: 154)
RATFSRDNAKNSAYLQMNSLRAEDTAVYYCAR   (SEQ ID NO: 155)
RATFSADTAKNALYMQMNSLRAEDTAVYYCAR   (SEQ ID NO: 156)
RATFSRDNAKNSLYLQLNSLRAEDTAVYYCAR   (SEQ ID NO: 157)
RATISADTAKNSLYLQMNSLRAEDTAVYYCAR   (SEQ ID NO: 158)
RATISADNAKNSAYLQMNSLRAEDTAVYYCAR   (SEQ ID NO: 159)
RATISADNAKNSAYMQMNSLRAEDTAVYYCAR   (SEQ ID NO: 160)
RATISADNAKNSLYLQLNSLRAEDTAVYYCAR   (SEQ ID NO: 161)
RATISRDTAKNSAYLQMNSLRAEDTAVYYCAR   (SEQ ID NO: 162)
RATISRDTAKNSLYMQMNSLRAEDTAVYYCAR   (SEQ ID NO: 163)
RATISRDTAKNSLYLQLNSLRAEDTAVYYCAR   (SEQ ID NO: 164)
RATISRDNAKNSAYMQMNSLRAEDTAVYYCAR   (SEQ ID NO: 165)
RATISRDNAKNSAYLQLNSLRAEDTAVYYCAR   (SEQ ID NO: 166)
RATISRDNAKNSLYMQLNSLRAEDTAVYYCAR   (SEQ ID NO: 167)
RPTFSADTAKNSLYLQMNSLRAEDTAVYYCAR   (SEQ ID NO: 168)
RPTFSADNAKNSAYLQMNSLRAEDTAVYYCAR   (SEQ ID NO: 169)
RPTFSADNAKNSLYLQMNSLRAEDTAVYYCAR   (SEQ ID NO: 170)
RPTFSADNAKNSLYLQLNSLRAEDTAVYYCAR   (SEQ ID NO: 171)
RPTFSRDTAKNSAYLQMNSLRAEDTAVYYCAR   (SEQ ID NO: 172)
RPTFSRDTAKNSLYMQMNSLRAEDTAVYYCAR   (SEQ ID NO: 173)
RPTFSRDTAKNSLYLQLNSLRAEDTAVYYCAR   (SEQ ID NO: 174)
RPTFSRDNAKNSAYMQMNSLRAEDTAVYYCAR   (SEQ ID NO: 175)
RPTFSRDNAKNSAYLQLNSLRAEDTAVYYCAR   (SEQ ID NO: 176)
RPTFSRDNAKNSLYMQLNSLRAEDTAVYYCAR   (SEQ ID NO: 177)
RFTISADTAKNSAYLQMNSLRAEDTAVYYCAR   (SEQ ID NO: 178)
RFTISADTAKNSLYMQMNSLRAEDTAVYYCAR   (SEQ ID NO: 179)
RFTISADTAKNSLYLQLNSLRAEDTAVYYCAR   (SEQ ID NO: 180)
RFTISADNAKNSAYMQMNSLRAEDTAVYYCAR   (SEQ ID NO: 181)
RFTISADNAKNSAYLQLNSLRAEDTAVYYCAR   (SEQ ID NO: 182)
RFTISADNAKNSLYMQLNSLRAEDTAVYYCAR   (SEQ ID NO: 183)
RFTISRDTAKNSAYMQMNSLRAEDTAVYYCAR   (SEQ ID NO: 184)
RFTISRDTAKNSAYLQLNSLRAEDTAVYYCAR   (SEQ ID NO: 185)
RFTISRDTAKNSLYLQMNSLRAEDTAVYYCAR   (SEQ ID NO: 186)
RFTISRDNAKNSAYMQLNSLRAEDTAVYYCAR   (SEQ ID NO: 187)
RATFSADTAKNSLYLQMNSLRAEDTAVYYCAR   (SEQ ID NO: 188)
RATFSADTAKNSAYMQMNSLRAEDTAVYYCAR   (SEQ ID NO: 189)
RATFSADNAKNSAYLQMNSLRAEDTAVYYCAR   (SEQ ID NO: 190)
RATFSADNAKNSLYLQMNSLRAEDTAVYYCAR   (SEQ ID NO: 191)
RATFSRDTAKNSAYMQMNSLRAEDTAVYYCAR   (SEQ ID NO: 192)
RATFSRDTAKNSLYMQMNSLRAEDTAVYYCAR   (SEQ ID NO: 193)
RATFSRDTAKNSLYLQLNSLRAEDTAVYYCAR   (SEQ ID NO: 194)
RATFSRDNAKNSAYLQMNSLRAEDTAVYYCAR   (SEQ ID NO: 195)
RATFSRDNAKNSAYLQLNSLRAEDTAVYYCAR   (SEQ ID NO: 196)
RATFSRDNAKNSLYMQLNSLRAEDTAVYYCAR   (SEQ ID NO: 197)
RATISADTAKNALYLQMNSLRAEDTAVYYCAR   (SEQ ID NO: 198)
RATISADTAKNSLYMQMNSLRAEDTAVYYCAR   (SEQ ID NO: 199)
RATISADTAKNSLYLQLNSLRAEDTAVYYCAR   (SEQ ID NO: 200)
RATISADNAKNSAYMQMNSLRAEDTAVYYCAR   (SEQ ID NO: 201)
RATISADNAKNSAYLQLNSLRAEDTAVYYCAR   (SEQ ID NO: 202)
RATISADNAKNSLYMQLNSLRAEDTAVYYCAR   (SEQ ID NO: 203)
RATISRDTAKNSAYMQMNSLRAEDTAVYYCAR   (SEQ ID NO: 204)
RATISRDTAKNSAYLQLNSLRAEDTAVYYCAR   (SEQ ID NO: 205)
RATISRDTAKNSLYLQMNSLRAEDTAVYYCAR   (SEQ ID NO: 206)
RATISRDNAKNSAYMQLNSLRAEDTAVYYCAR   (SEQ ID NO: 207)
RPTFSADTAKNSAYLQMNSLRAEDTAVYYCAR   (SEQ ID NO: 208)
RPTFSADTAKNSLYMQMNSLRAEDTAVYYCAR   (SEQ ID NO: 209)
RPTFSADTAKNSLYLQLNSLRAEDTAVYYCAR   (SEQ ID NO: 210)
RPTFSADNAKNSAYMQMNSLRAEDTAVYYCAR   (SEQ ID NO: 211)
RPTFSADNAKNSAYLQLNSLRAEDTAVYYCAR   (SEQ ID NO: 212)
RPTFSADNAKNSLYMQLNSLRAEDTAVYYCAR   (SEQ ID NO: 213)
RPTFSRDTAKNSAYMQMNSLRAEDTAVYYCAR   (SEQ ID NO: 214)
RPTFSRDTAKNSAYLQMNSLRAEDTAVYYCAR   (SEQ ID NO: 215)
RPTFSRDTAKNSLYMQMNSLRAEDTAVYYCAR   (SEQ ID NO: 216)
RPTFSRDNAKNSAYMQLNSLRAEDTAVYYCAR   (SEQ ID NO: 217)
RFTISADTAKNSAYMQMNSLRAEDTAVYYCAR   (SEQ ID NO: 218)
RFTISADTAKNSAYLQLNSLRAEDTAVYYCAR   (SEQ ID NO: 219)
RFTISADTAKNSLYMQMNSLRAEDTAVYYCAR   (SEQ ID NO: 220)
RFTISADNAKNSAYMQLNSLRAEDTAVYYCAR   (SEQ ID NO: 221)
RFTISRDNAKNSAYMQLNSLRAEDTAVYYCAR   (SEQ ID NO: 222)
RATFSADTAKNSAYLQMNSLRAEDTAVYYCAR   (SEQ ID NO: 223)
RATFSADTAKNSLYMQMNSLRAEDTAVYYCAR   (SEQ ID NO: 224)
RATFSADTAKNSLYLQLNSLRAEDTAVYYCAR   (SEQ ID NO: 225)
RATFSADNAKNSAYMQMNSLRAEDTAVYYCAR   (SEQ ID NO: 226)
RATFSADNAKNSAYLQLNSLRAEDTAVYYCAR   (SEQ ID NO: 227)
RATFSADNAKNSLYMQLNSLRAEDTAVYYCAR   (SEQ ID NO: 228)
RATFSRDTAKNSAYMQMNSLRAEDTAVYYCAR   (SEQ ID NO: 229)
RATFSRDTAKNSAYLQLNSLRAEDTAVYYCAR   (SEQ ID NO: 230)
RATFSRDTAKNSLYMQLNSLRAEDTAVYYCAR   (SEQ ID NO: 231)
RATFSRDTAKNSAYMQLNSLRAEDTAVYYCAR   (SEQ ID NO: 232)
RATISADTAKNALYMQMNSLRAEDTAVYYCAR   (SEQ ID NO: 233)
RATISADTAKNALYLQLNSLRAEDTAVYYCAR   (SEQ ID NO: 234)
RATISADTAKNSLYMQLNSLRAEDTAVYYCAR   (SEQ ID NO: 235)
RATISADNAKNSAYMQLNSLRAEDTAVYYCAR   (SEQ ID NO: 236)
RATISRDTAKNSAYMQLNSLRAEDTAVYYCAR   (SEQ ID NO: 237)
RFTFSADTAKNSAYMQMNSLRAEDTAVYYCAR   (SEQ ID NO: 238)
RFTFSADTAKNSAYLQLNSLRAEDTAVYYCAR   (SEQ ID NO: 239)
RFTFSADTAKNSLYMQLNSLRAEDTAVYYCAR   (SEQ ID NO: 240)
RFTFSADNAKNSAYMQLNSLRAEDTAVYYCAR   (SEQ ID NO: 241)
RFTFSRDTAKNSAYMQLNSLRAEDTAVYYCAR   (SEQ ID NO: 242)
RFTISADTAKNSAYMQLNSLRAEDTAVYYCAR   (SEQ ID NO: 243)
RATFSADTAKNSAYMQMNSLRAEDTAVYYCAR   (SEQ ID NO: 244)
RATFSADTAKNSAYLQLNSLRAEDTAVYYCAR   (SEQ ID NO: 245)
RATFSADTAKNSLYMQLNSLRAEDTAVYYCAR   (SEQ ID NO: 246)
RATFSADNAKNSAYMQLNSLRAEDTAVYYCAR   (SEQ ID NO: 247)
RATFSRDTAKNSAYMQLNSLRAEDTAVYYCAR   (SEQ ID NO: 248)
RATISADTAKNALYMQLNSLRAEDTAVYYCAR   (SEQ ID NO: 249)
RFTFSADTAKNSAYMQLNSLRAEDTAVYYCAR   (SEQ ID NO: 250)
RATFSADTAKNSAYMQLNSLRAEDTAVYYCAR   (SEQ ID NO: 251)
RFTISRDNAKNSLYLQMNSLRAEDTAVYYCAG   (SEQ ID NO: 903)
RATISRDNAKNSLYLQMNSLRAEDTAVYYCAG   (SEQ ID NO: 904)
RFTFSRDNAKNSLYLQMNSLRAEDTAVYYCAG   (SEQ ID NO: 905)
RFTISADNAKNSLYLQMNSLRAEDTAVYYCAG   (SEQ ID NO: 906)
RFTISRDTAKNSLYLQMNSLRAEDTAVYYCAG   (SEQ ID NO: 907)
RFTISRDNAKNSAYLQMNSLRAEDTAVYYCAG   (SEQ ID NO: 908)
RFTISRDNAKNSLYMQMNSLRAEDTAVYYCAG   (SEQ ID NO: 909)
RFTISRDNAKNSLYLQLNSLRAEDTAVYYCAG   (SEQ ID NO: 910)
RATFSRDNAKNSLYLQMNSLRAEDTAVYYCAG   (SEQ ID NO: 911)
RATISADNAKNSLYLQMNSLRAEDTAVYYCAG   (SEQ ID NO: 912)
RATISRDTAKNSLYLQMNSLRAEDTAVYYCAG   (SEQ ID NO: 913)
RATISRDNAKNSAYLQMNSLRAEDTAVYYCAG   (SEQ ID NO: 914)
RATISRDNAKNSLYMQMNSLRAEDTAVYYCAG   (SEQ ID NO: 915)
RATISRDNAKNSLYLQLNSLRAEDTAVYYCAG   (SEQ ID NO: 916)
RATISRDNAKNSLYLQMNSLRAEDTAVYYCAG   (SEQ ID NO: 917)
RFTFSRDTAKNSLYLQMNSLRAEDTAVYYCAG   (SEQ ID NO: 918)
RFTFSRDNAKNSAYLQMNSLRAEDTAVYYCAG   (SEQ ID NO: 919)
RFTFSRDNAKNSLYMQMNSLRAEDTAVYYCAG   (SEQ ID NO: 920)
RFTFSRDNAKNSLYLQLNSLRAEDTAVYYCAG   (SEQ ID NO: 921)
RFTISADTAKNSLYLQMNSLRAEDTAVYYCAG   (SEQ ID NO: 922)
RFTISADNAKNSAYLQMNSLRAEDTAVYYCAG   (SEQ ID NO: 923)
RFTISADNAKNSLYMQMNSLRAEDTAVYYCAG   (SEQ ID NO: 924)
RFTISADNAKNSLYLQLNSLRAEDTAVYYCAG   (SEQ ID NO: 925)
RFTISRDTAKNSAYLQMNSLRAEDTAVYYCAG   (SEQ ID NO: 926)
RFTISRDTAKNSLYMQMNSLRAEDTAVYYCAG   (SEQ ID NO: 927)
RFTISRDTAKNSLYLQLNSLRAEDTAVYYCAG   (SEQ ID NO: 928)
RFTISRDNAKNSAYMQMNSLRAEDTAVYYCAG   (SEQ ID NO: 929)
RFTISRDNAKNSAYLQLNSLRAEDTAVYYCAG   (SEQ ID NO: 930)
RFTISRDNAKNSLYMQLNSLRAEDTAVYYCAG   (SEQ ID NO: 931)
RATFSADNAKNSLYLQMNSLRAEDTAVYYCAG   (SEQ ID NO: 932)
RATFSRDTAKNSLYLQMNSLRAEDTAVYYCAG   (SEQ ID NO: 933)
RATFSRDNAKNSAYLQMNSLRAEDTAVYYCAG   (SEQ ID NO: 934)
RATFSRDNAKNSLYMQMNSLRAEDTAVYYCAG   (SEQ ID NO: 935)
RATFSRDNAKNSLYLQLNSLRAEDTAVYYCAG   (SEQ ID NO: 936)
RATISADTAKNSLYLQMNSLRAEDTAVYYCAG   (SEQ ID NO: 937)
RATISADNAKNSAYLQMNSLRAEDTAVYYCAG   (SEQ ID NO: 938)
RATISADNAKNSLYMQMNSLRAEDTAVYYCAG   (SEQ ID NO: 939)
RATISADNAKNSLYLQLNSLRAEDTAVYYCAG   (SEQ ID NO: 940)
RATISRDTAKNSAYLQMNSLRAEDTAVYYCAG   (SEQ ID NO: 941)
RATISRDTAKNSLYMQMNSLRAEDTAVYYCAG   (SEQ ID NO: 942)
RATISRDTAKNSLYLQLNSLRAEDTAVYYCAG   (SEQ ID NO: 943)
RATISRDNAKNSAYMQMNSLRAEDTAVYYCAG   (SEQ ID NO: 944)
RATISRDNAKNSAYLQLNSLRAEDTAVYYCAG   (SEQ ID NO: 945)
RATISRDNAKNSLYMQLNSLRAEDTAVYYCAG   (SEQ ID NO: 946)
RFTFSADTAKNSLYLQMNSLRAEDTAVYYCAG   (SEQ ID NO: 947)
RFTFSADNAKNSAYLQMNSLRAEDTAVYYCAG   (SEQ ID NO: 948)
RFTFSADNAKNSLYMQMNSLRAEDTAVYYCAG   (SEQ ID NO: 949)
RFTFSADNAKNSLYLQLNSLRAEDTAVYYCAG   (SEQ ID NO: 950)
RFTFSRDTAKNSAYLQMNSLRAEDTAVYYCAG   (SEQ ID NO: 951)
```

TABLE 7-continued

Amino Acid Sequences derived from Murine 141A Antibody.

RFTFSRDTAKNSLYMQMNSLRAEDTAVYYCAG (SEQ ID NO: 952)
RFTFSRDTAKNSLYLQLNSLRAEDTAVYYCAG (SEQ ID NO: 953)
RFTFSRDNAKNSAYMQMNSLRAEDTAVYYCAG (SEQ ID NO: 954)
RFTFSRDNAKNSAYLQLNSLRAEDTAVYYCAG (SEQ ID NO: 955)
RFTFSRDTAKNSLYMQMNSLRAEDTAVYYCAG (SEQ ID NO: 956)
RFTISADTAKNSAYLQLNSLRAEDTAVYYCAG (SEQ ID NO: 957)
RFTISADTAKNSLYMQMNSLRAEDTAVYYCAG (SEQ ID NO: 958)
RFTISADTAKNSLYLQLNSLRAEDTAVYYCAG (SEQ ID NO: 959)
RFTISADNAKNSAYLQLNSLRAEDTAVYYCAG (SEQ ID NO: 960)
RFTISADNAKNSAYLQLNSLRAEDTAVYYCAG (SEQ ID NO: 961)
RFTISADNAKNSLYMQLNSLRAEDTAVYYCAG (SEQ ID NO: 962)
RFTISRDTAKNSAYMQMNSLRAEDTAVYYCAG (SEQ ID NO: 963)
RFTISRDTAKNSAYLQLNSLRAEDTAVYYCAG (SEQ ID NO: 964)
RFTISRDTAKNSLYMQLNSLRAEDTAVYYCAG (SEQ ID NO: 965)
RFTISRDNAKNSAYMQMNSLRAEDTAVYYCAG (SEQ ID NO: 966)
RATFSADTAKNSLYMQMNSLRAEDTAVYYCAG (SEQ ID NO: 967)
RATFSADNAKNSAYLQMNSLRAEDTAVYYCAG (SEQ ID NO: 968)
RATFSADNAKNSLYMQLNSLRAEDTAVYYCAG (SEQ ID NO: 969)
RATFSADNAKNSLYLQLNSLRAEDTAVYYCAG (SEQ ID NO: 970)
RATFSRDTAKNSAYMQMNSLRAEDTAVYYCAG (SEQ ID NO: 971)
RATFSRDTAKNSLYMQMNSLRAEDTAVYYCAG (SEQ ID NO: 972)
RATFSRDTAKNSLYLQLNSLRAEDTAVYYCAG (SEQ ID NO: 973)
RATFSRDTAKNSLYMQLNSLRAEDTAVYYCAG (SEQ ID NO: 974)
RATFSRDNAKNSAYLQMNSLRAEDTAVYYCAG (SEQ ID NO: 975)
RATFSRDNAKNSLYMQMNSLRAEDTAVYYCAG (SEQ ID NO: 976)
RATISADTAKNALYMQMNSLRAEDTAVYYCAG (SEQ ID NO: 977)
RATISADTAKNSLYMQMNSLRAEDTAVYYCAG (SEQ ID NO: 978)
RATISADTAKNSLYLQLNSLRAEDTAVYYCAG (SEQ ID NO: 979)
RATISADNAKNSAYMQMNSLRAEDTAVYYCAG (SEQ ID NO: 980)
RATISADNAKNSAYMQMNSLRAEDTAVYYCAG (SEQ ID NO: 981)
RATISADNAKNSLYMQLNSLRAEDTAVYYCAG (SEQ ID NO: 982)
RATISRDTAKNSAYMQMNSLRAEDTAVYYCAG (SEQ ID NO: 983)
RATISRDTAKNSAYLQLNSLRAEDTAVYYCAG (SEQ ID NO: 984)
RATISRDTAKNSLYMQLNSLRAEDTAVYYCAG (SEQ ID NO: 985)
RATISRDNAKNSAYMQLNSLRAEDTAVYYCAG (SEQ ID NO: 986)
RFTFSADTAKNSAYMQMNSLRAEDTAVYYCAG (SEQ ID NO: 987)
RFTFSADTAKNSLYMQMNSLRAEDTAVYYCAG (SEQ ID NO: 988)
RFTFSADTAKNSLYLQLNSLRAEDTAVYYCAG (SEQ ID NO: 989)
RFTFSADNAKNSAYMQMNSLRAEDTAVYYCAG (SEQ ID NO: 990)
RFTFSADNAKNSAYMQMNSLRAEDTAVYYCAG (SEQ ID NO: 991)
RFTFSADNAKNSLYMQLNSLRAEDTAVYYCAG (SEQ ID NO: 992)
RFTFSRDTAKNSAYMQMNSLRAEDTAVYYCAG (SEQ ID NO: 993)
RFTFSRDTAKNSLYMQLNSLRAEDTAVYYCAG (SEQ ID NO: 994)
RFTFSRDTAKNSLYMQLNSLRAEDTAVYYCAG (SEQ ID NO: 995)
RFTFSRDNAKNSAYMQLNSLRAEDTAVYYCAG (SEQ ID NO: 996)
RFTISADTAKNSAYMQMNSLRAEDTAVYYCAG (SEQ ID NO: 997)
RFTISADTAKNSAYLQLNSLRAEDTAVYYCAG (SEQ ID NO: 998)
RFTISADTAKNSLYMQLNSLRAEDTAVYYCAG (SEQ ID NO: 999)
RFTISADNAKNSAYMQMNSLRAEDTAVYYCAG (SEQ ID NO: 1000)
RFTISRDTAKNSAYMQLNSLRAEDTAVYYCAG (SEQ ID NO: 1001)
RATFSADTAKNSAYMQMNSLRAEDTAVYYCAG (SEQ ID NO: 1002)
RATFSADTAKNSLYMQMNSLRAEDTAVYYCAG (SEQ ID NO: 1003)
RATFSADTAKNSLYLQLNSLRAEDTAVYYCAG (SEQ ID NO: 1004)
RATFSADNAKNSAYMQMNSLRAEDTAVYYCAG (SEQ ID NO: 1005)
RATFSADNAKNSAYLQLNSLRAEDTAVYYCAG (SEQ ID NO: 1006)
RATFSADNAKNSLYMQLNSLRAEDTAVYYCAG (SEQ ID NO: 1007)
RATFSRDTAKNSAYMQMNSLRAEDTAVYYCAG (SEQ ID NO: 1008)
RATFSRDTAKNSAYLQLNSLRAEDTAVYYCAG (SEQ ID NO: 1009)
RATFSRDTAKNSLYMQLNSLRAEDTAVYYCAG (SEQ ID NO: 1010)
RATFSRDNAKNSAYMQLNSLRAEDTAVYYCAG (SEQ ID NO: 1011)
RATISADTAKNALYMQMNSLRAEDTAVYYCAG (SEQ ID NO: 1012)
RATISADTAKNALYLQLNSLRAEDTAVYYCAG (SEQ ID NO: 1013)
RATISADTAKNSLYMQLNSLRAEDTAVYYCAG (SEQ ID NO: 1014)
RATISADNAKNSAYMQMNSLRAEDTAVYYCAG (SEQ ID NO: 1015)
RATISADNAKNSLYMQLNSLRAEDTAVYYCAG (SEQ ID NO: 1016)
RFTFSADTAKNSAYMQMNSLRAEDTAVYYCAG (SEQ ID NO: 1017)
RFTFSADTAKNSAYLQLNSLRAEDTAVYYCAG (SEQ ID NO: 1018)
RFTFSADTAKNSLYMQLNSLRAEDTAVYYCAG (SEQ ID NO: 1019)
RFTFSADNAKNSAYMQLNSLRAEDTAVYYCAG (SEQ ID NO: 1020)
RFTFSRDTAKNSAYMQLNSLRAEDTAVYYCAG (SEQ ID NO: 1021)
RFTISADTAKNSAYMQLNSLRAEDTAVYYCAG (SEQ ID NO: 1022)
RATFSADTAKNSAYMQLNSLRAEDTAVYYCAG (SEQ ID NO: 1023)
RATFSADTAKNSAYLQLNSLRAEDTAVYYCAG (SEQ ID NO: 1024)
RATFSADTAKNSLYMQLNSLRAEDTAVYYCAG (SEQ ID NO: 1025)
RATFSADNAKNSAYMQLNSLRAEDTAVYYCAG (SEQ ID NO: 1026)
RATFSRDTAKNSAYMQLNSLRAEDTAVYYCAG (SEQ ID NO: 1027)
RATISADTAKNALYMQLNSLRAEDTAVYYCAG (SEQ ID NO: 1028)
RFTFSADTAKNSAYMQLNSLRAEDTAVYYCAG (SEQ ID NO: 1029)
RATFSADTAKNSAYMQLNSLRAEDTAVYYCAG (SEQ ID NO: 1030)

141A-huVH3a VH CDR3
EEVYDGYPWFGY (SEQ ID NO: 35)
EEVYEGYPWFGY (SEQ ID NO: 883)
EEVYSGYPWFGY (SEQ ID NO: 884)
EEVYAGYPWFGY (SEQ ID NO: 885)

141A-huVH3a VH FR4
WGQGTLVTVSS (SEQ ID NO: 54)

141A-huVH3b Variable Region
EVQLVESGGGLVQPGGSLRLSCAASGYTFSRYWIEWVRQAPGKGLEWVS**E
ILPGSGSTNYADSVKGRFTISRDNAKNSLYLQMNSLRAEDTAVYYCAREE
VYDGYPWFGY**WGQGTLVTVSS (SEQ ID NO: 19)

141A-huVH3b VH FR1
EVQLVESGGGLVQPGGSLRLSCAAS (SEQ ID NO: 55)
EVQLVQSGGGLVQPGGSLRLSCAAS (SEQ ID NO: 115)
EVQLVESGGGLVQPGGSVRLSCAAS (SEQ ID NO: 116)
EVQLVESGGGLVQPGGSLRISCAAS (SEQ ID NO: 117)
EVQLVQSGGGLVQPGGSVRLSCAAS (SEQ ID NO: 118)
EVQLVESGGGLVQPGGSVRISCAAS (SEQ ID NO: 119)
EVQLVQSGGGLVQPGGSLRISCAAS (SEQ ID NO: 120)
EVQLVQSGGGLVQPGGSVRISCAAS (SEQ ID NO: 121)
EVQLVESGGGLMQPGGSLRLSCAAS (SEQ ID NO: 895)
EVQLVQSGGGLMQPGGSLRLSCAAS (SEQ ID NO: 896)
EVQLVESGGGLMQPGGSVRLSCAAS (SEQ ID NO: 897)
EVQLVQSGGGLMQPGGSLRISCAAS (SEQ ID NO: 898)
EVQLVQSGGGLMQPGGSVRLSCAAS (SEQ ID NO: 899)
EVQLVQSGGGLMQPGGSLRISCAAS (SEQ ID NO: 900)
EVQLVESGGGLMQPGGSVRISCAAS (SEQ ID NO: 901)
EVQLVQSGGGLMQPGGSVRISCAAS (SEQ ID NO: 902)

141A-huVH3b VH CDR1
GYTFSRYWIE (SEQ ID NO: 33)

141A-huVH3b VH FR2
WVRQAPGKGLEWVS (SEQ ID NO: 56)
WVRQAPGKGLEWIS (SEQ ID NO: 122)
WVRQAPGKGLEWVG (SEQ ID NO: 123)
WVRQAPGKGLEWIG (SEQ ID NO: 124)

141A-huVH3b VH CDR2*
EILPGSGSTNYADSVKG (SEQ ID NO: 1070)
EILPGSGSTQYADSVKG (SEQ ID NO: 1071)
EILPGSGSTSYADSVKG (SEQ ID NO: 99)
EILPGSGSTDYADSVKG (SEQ ID NO: 1072)
EILPGSGSTAYADSVKG (SEQ ID NO: 1073)
EILPGSGSTNYADSFKG (SEQ ID NO: 1074)
EILPGSGSTQYADSFKG (SEQ ID NO: 1075)
EILPGSGSTSYADSFKG (SEQ ID NO: 1076)
EILPGSGSTDYADSFKG (SEQ ID NO: 1077)
EILPGSGSTAYADSFKG (SEQ ID NO: 1078)

141A-huVH3b VH FR3
RFTISRDNAKNSLYLQMNSLRAEDTAVYYCAR (SEQ ID NO: 57)
RATISRDNAKNSLYLQMNSLRAEDTAVYYCAR (SEQ ID NO: 125)
RFTFSRDNAKNSLYLQMNSLRAEDTAVYYCAR (SEQ ID NO: 126)
RFTISADNAKNSLYLQMNSLRAEDTAVYYCAR (SEQ ID NO: 127)
RFTISRDTAKNSLYLQMNSLRAEDTAVYYCAR (SEQ ID NO: 128)
RFTISRDNAKNSAYLQMNSLRAEDTAVYYCAR (SEQ ID NO: 129)
RFTISRDNAKNSLYMQMNSLRAEDTAVYYCAR (SEQ ID NO: 130)
RFTISRDNAKNSLYLQLNSLRAEDTAVYYCAR (SEQ ID NO: 131)
RATFSRDNAKNSLYLQMNSLRAEDTAVYYCAR (SEQ ID NO: 132)
RATISADNAKNSLYLQMNSLRAEDTAVYYCAR (SEQ ID NO: 133)
RATISRDTAKNSLYLQMNSLRAEDTAVYYCAR (SEQ ID NO: 134)
RATISRDNAKNSAYLQMNSLRAEDTAVYYCAR (SEQ ID NO: 135)
RATISRDNAKNSLYMQMNSLRAEDTAVYYCAR (SEQ ID NO: 136)
RATISRDNAKNSLYLQLNSLRAEDTAVYYCAR (SEQ ID NO: 137)
RFTFSRDTAKNSLYLQMNSLRAEDTAVYYCAR (SEQ ID NO: 138)
RFTFSRDTAKNSLYLQMNSLRAEDTAVYYCAR (SEQ ID NO: 139)
RFTFSRDNAKNSAYLQMNSLRAEDTAVYYCAR (SEQ ID NO: 140)
RFTFSRDNAKNSLYMQMNSLRAEDTAVYYCAR (SEQ ID NO: 141)
RFTFSRDNAKNSLYLQLNSLRAEDTAVYYCAR (SEQ ID NO: 142)
RFTFSADTAKNSLYMQMNSLRAEDTAVYYCAR (SEQ ID NO: 143)

TABLE 7-continued

Amino Acid Sequences derived from Murine 141A Antibody.

```
RFTISADNAKNSAYLQMNSLRAEDTAVYYCAR  (SEQ ID NO: 144)
RFTISADNAKNSLYMQMNSLRAEDTAVYYCAR  (SEQ ID NO: 145)
RFTISADNAKNSLYLQLNSLRAEDTAVYYCAR  (SEQ ID NO: 146)
RFTISRDTAKNSAYLQMNSLRAEDTAVYYCAR  (SEQ ID NO: 147)
RFTISRDTAKNSLYMQMNSLRAEDTAVYYCAR  (SEQ ID NO: 148)
RFTISRDTAKNSLYLQLNSLRAEDTAVYYCAR  (SEQ ID NO: 149)
RFTISRDNAKNSAYMQMNSLRAEDTAVYYCAR  (SEQ ID NO: 150)
RFTISRDNAKNSAYLQLNSLRAEDTAVYYCAR  (SEQ ID NO: 151)
RFTISRDNAKNSLYMQLNSLRAEDTAVYYCAR  (SEQ ID NO: 152)
RATFSADNAKNSLYLQLNSLRAEDTAVYYCAR  (SEQ ID NO: 153)
RATFSRDTAKNSLYLQMNSLRAEDTAVYYCAR  (SEQ ID NO: 154)
RATFSRDNAKNSAYLQMNSLRAEDTAVYYCAR  (SEQ ID NO: 155)
RATFSRDNAKNSLYMQMNSLRAEDTAVYYCAR  (SEQ ID NO: 156)
RATFSRDNAKNSLYLQLNSLRAEDTAVYYCAR  (SEQ ID NO: 157)
RATISADTAKNSLYLQMNSLRAEDTAVYYCAR  (SEQ ID NO: 158)
RATISADNAKNSAYLQMNSLRAEDTAVYYCAR  (SEQ ID NO: 159)
RATISADNAKNSLYMQMNSLRAEDTAVYYCAR  (SEQ ID NO: 160)
RATISADNAKNSLYLQLNSLRAEDTAVYYCAR  (SEQ ID NO: 161)
RATISRDTAKNSAYLQMNSLRAEDTAVYYCAR  (SEQ ID NO: 162)
RATISRDTAKNSLYMQMNSLRAEDTAVYYCAR  (SEQ ID NO: 163)
RATISRDTAKNSLYLQLNSLRAEDTAVYYCAR  (SEQ ID NO: 164)
RATISRDNAKNSAYMQMNSLRAEDTAVYYCAR  (SEQ ID NO: 165)
RATISRDNAKNSAYLQLNSLRAEDTAVYYCAR  (SEQ ID NO: 166)
RATISRDNAKNSLYMQLNSLRAEDTAVYYCAR  (SEQ ID NO: 167)
RFTFSADTAKNSLYLQMNSLRAEDTAVYYCAR  (SEQ ID NO: 168)
RFTFSADNAKNSAYLQMNSLRAEDTAVYYCAR  (SEQ ID NO: 169)
RFTFSADNAKNSLYMQMNSLRAEDTAVYYCAR  (SEQ ID NO: 170)
RFTFSADNAKNSLYLQLNSLRAEDTAVYYCAR  (SEQ ID NO: 171)
RFTFSRDTAKNSAYLQMNSLRAEDTAVYYCAR  (SEQ ID NO: 172)
RFTFSRDTAKNSLYMQMNSLRAEDTAVYYCAR  (SEQ ID NO: 173)
RFTFSRDTAKNSLYLQLNSLRAEDTAVYYCAR  (SEQ ID NO: 174)
RFTFSRDNAKNSAYMQMNSLRAEDTAVYYCAR  (SEQ ID NO: 175)
RFTFSRDNAKNSAYLQLNSLRAEDTAVYYCAR  (SEQ ID NO: 176)
RFTFSRDNAKNSLYMQLNSLRAEDTAVYYCAR  (SEQ ID NO: 177)
RFTISADTAKNSAYLQMNSLRAEDTAVYYCAR  (SEQ ID NO: 178)
RFTISADTAKNSLYMQMNSLRAEDTAVYYCAR  (SEQ ID NO: 179)
RFTISADTAKNSLYLQLNSLRAEDTAVYYCAR  (SEQ ID NO: 180)
RFTISADNAKNSAYMQMNSLRAEDTAVYYCAR  (SEQ ID NO: 181)
RFTISADNAKNSAYLQLNSLRAEDTAVYYCAR  (SEQ ID NO: 182)
RFTISADNAKNSLYMQLNSLRAEDTAVYYCAR  (SEQ ID NO: 183)
RFTISRDTAKNSAYMQMNSLRAEDTAVYYCAR  (SEQ ID NO: 184)
RFTISRDTAKNSAYLQLNSLRAEDTAVYYCAR  (SEQ ID NO: 185)
RFTISRDTAKNSLYMQLNSLRAEDTAVYYCAR  (SEQ ID NO: 186)
RFTISRDNAKNSAYMQLNSLRAEDTAVYYCAR  (SEQ ID NO: 187)
RATFSADTAKNSLYLQMNSLRAEDTAVYYCAR  (SEQ ID NO: 188)
RATFSADNAKNSAYLQMNSLRAEDTAVYYCAR  (SEQ ID NO: 189)
RATFSADNAKNSLYMQMNSLRAEDTAVYYCAR  (SEQ ID NO: 190)
RATFSADNAKNSLYLQLNSLRAEDTAVYYCAR  (SEQ ID NO: 191)
RATFSRDTAKNSAYLQMNSLRAEDTAVYYCAR  (SEQ ID NO: 192)
RATFSRDTAKNSLYMQMNSLRAEDTAVYYCAR  (SEQ ID NO: 193)
RATFSRDTAKNSLYLQLNSLRAEDTAVYYCAR  (SEQ ID NO: 194)
RATFSRDNAKNSAYMQMNSLRAEDTAVYYCAR  (SEQ ID NO: 195)
RATFSRDNAKNSAYLQLNSLRAEDTAVYYCAR  (SEQ ID NO: 196)
RATFSRDNAKNSLYMQLNSLRAEDTAVYYCAR  (SEQ ID NO: 197)
RATISADTAKNALYLQMNSLRAEDTAVYYCAR  (SEQ ID NO: 198)
RATISADTAKNSLYMQMNSLRAEDTAVYYCAR  (SEQ ID NO: 199)
RATISADTAKNSLYLQLNSLRAEDTAVYYCAR  (SEQ ID NO: 200)
RATISADNAKNSAYMQMNSLRAEDTAVYYCAR  (SEQ ID NO: 201)
RATISADNAKNSAYLQLNSLRAEDTAVYYCAR  (SEQ ID NO: 202)
RATISADNAKNSLYMQLNSLRAEDTAVYYCAR  (SEQ ID NO: 203)
RATISRDTAKNSAYMQMNSLRAEDTAVYYCAR  (SEQ ID NO: 204)
RATISRDTAKNSAYLQLNSLRAEDTAVYYCAR  (SEQ ID NO: 205)
RATISRDTAKNSLYMQLNSLRAEDTAVYYCAR  (SEQ ID NO: 206)
RATISRDNAKNSAYMQLNSLRAEDTAVYYCAR  (SEQ ID NO: 207)
RFTFSADTAKNSAYLQMNSLRAEDTAVYYCAR  (SEQ ID NO: 208)
RFTFSADTAKNSLYMQMNSLRAEDTAVYYCAR  (SEQ ID NO: 209)
RFTFSADTAKNSLYLQLNSLRAEDTAVYYCAR  (SEQ ID NO: 210)
RFTFSADNAKNSAYMQMNSLRAEDTAVYYCAR  (SEQ ID NO: 211)
RFTFSADNAKNSAYLQLNSLRAEDTAVYYCAR  (SEQ ID NO: 212)
RFTFSADNAKNSLYMQLNSLRAEDTAVYYCAR  (SEQ ID NO: 213)
RFTFSRDTAKNSAYMQMNSLRAEDTAVYYCAR  (SEQ ID NO: 214)
RFTFSRDTAKNSAYLQLNSLRAEDTAVYYCAR  (SEQ ID NO: 215)
RFTFSRDTAKNSLYMQLNSLRAEDTAVYYCAR  (SEQ ID NO: 216)
RFTFSRDNAKNSAYMQLNSLRAEDTAVYYCAR  (SEQ ID NO: 217)
RFTISADTAKNSAYMQMNSLRAEDTAVYYCAR  (SEQ ID NO: 218)
RFTISADTAKNSAYLQLNSLRAEDTAVYYCAR  (SEQ ID NO: 219)
RFTISADTAKNSLYMQLNSLRAEDTAVYYCAR  (SEQ ID NO: 220)
RFTISADNAKNSAYMQLNSLRAEDTAVYYCAR  (SEQ ID NO: 221)
RFTISRDTAKNSAYMQLNSLRAEDTAVYYCAR  (SEQ ID NO: 222)
RATFSADTAKNSAYLQMNSLRAEDTAVYYCAR  (SEQ ID NO: 223)
RATFSADTAKNSLYMQMNSLRAEDTAVYYCAR  (SEQ ID NO: 224)
RATFSADTAKNSLYLQLNSLRAEDTAVYYCAR  (SEQ ID NO: 225)
RATFSADNAKNSAYMQMNSLRAEDTAVYYCAR  (SEQ ID NO: 226)
RATFSADNAKNSAYLQLNSLRAEDTAVYYCAR  (SEQ ID NO: 227)
RATFSADNAKNSLYMQLNSLRAEDTAVYYCAR  (SEQ ID NO: 228)
RATFSRDTAKNSAYMQMNSLRAEDTAVYYCAR  (SEQ ID NO: 229)
RATFSRDTAKNSAYLQLNSLRAEDTAVYYCAR  (SEQ ID NO: 230)
RATFSRDTAKNSLYMQLNSLRAEDTAVYYCAR  (SEQ ID NO: 231)
RATFSRDNAKNSAYMQLNSLRAEDTAVYYCAR  (SEQ ID NO: 232)
RATISADTAKNALYMQMNSLRAEDTAVYYCAR  (SEQ ID NO: 233)
RATISADTAKNALYLQLNSLRAEDTAVYYCAR  (SEQ ID NO: 234)
RATISADTAKNSLYMQLNSLRAEDTAVYYCAR  (SEQ ID NO: 235)
RATISADNAKNSAYMQLNSLRAEDTAVYYCAR  (SEQ ID NO: 236)
RATISRDTAKNSAYMQLNSLRAEDTAVYYCAR  (SEQ ID NO: 237)
RFTFSADTAKNSAYMQMNSLRAEDTAVYYCAR  (SEQ ID NO: 238)
RFTFSADTAKNSAYLQLNSLRAEDTAVYYCAR  (SEQ ID NO: 239)
RFTFSADTAKNSLYMQLNSLRAEDTAVYYCAR  (SEQ ID NO: 240)
RFTISADNAKNSAYMQLNSLRAEDTAVYYCAR  (SEQ ID NO: 241)
RFTFSRDTAKNSAYMQLNSLRAEDTAVYYCAR  (SEQ ID NO: 242)
RFTISADTAKNSAYMQLNSLRAEDTAVYYCAR  (SEQ ID NO: 243)
RATFSADTAKNSAYMQMNSLRAEDTAVYYCAR  (SEQ ID NO: 244)
RATFSADTAKNSAYLQLNSLRAEDTAVYYCAR  (SEQ ID NO: 245)
RATFSADTAKNSLYMQLNSLRAEDTAVYYCAR  (SEQ ID NO: 246)
RATFSADNAKNSAYMQLNSLRAEDTAVYYCAR  (SEQ ID NO: 247)
RATFSRDTAKNSAYMQLNSLRAEDTAVYYCAR  (SEQ ID NO: 248)
RATISADTAKNALYMQLNSLRAEDTAVYYCAR  (SEQ ID NO: 249)
RFTFSADTAKNSAYMQLNSLRAEDTAVYYCAR  (SEQ ID NO: 250)
RATFSADTAKNSAYMQLNSLRAEDTAVYYCAR  (SEQ ID NO: 251)
RFTISRDNAKNSLYLQMNSLRAEDTAVYYCAG  (SEQ ID NO: 903)
RATISRDNAKNSLYLQMNSLRAEDTAVYYCAG  (SEQ ID NO: 904)
RFTFSRDNAKNSLYLQMNSLRAEDTAVYYCAG  (SEQ ID NO: 905)
RATFSRDNAKNSLYLQMNSLRAEDTAVYYCAG  (SEQ ID NO: 906)
RFTISRDTAKNSLYLQMNSLRAEDTAVYYCAG  (SEQ ID NO: 907)
RFTISRDNAKNSAYLQMNSLRAEDTAVYYCAG  (SEQ ID NO: 908)
RFTISRDNAKNSLYMQMNSLRAEDTAVYYCAG  (SEQ ID NO: 909)
RFTISRDNAKNSLYLQLNSLRAEDTAVYYCAG  (SEQ ID NO: 910)
RATFSRDNAKNSLYLQLNSLRAEDTAVYYCAG  (SEQ ID NO: 911)
RATISADNAKNSLYLQMNSLRAEDTAVYYCAG  (SEQ ID NO: 912)
RATISRDTAKNSLYLQMNSLRAEDTAVYYCAG  (SEQ ID NO: 913)
RATISRDNAKNSAYLQMNSLRAEDTAVYYCAG  (SEQ ID NO: 914)
RATISRDNAKNSLYMQMNSLRAEDTAVYYCAG  (SEQ ID NO: 915)
RATISRDNAKNSLYLQLNSLRAEDTAVYYCAG  (SEQ ID NO: 916)
RFTFSADNAKNSLYLQMNSLRAEDTAVYYCAG  (SEQ ID NO: 917)
RFTFSRDTAKNSLYLQMNSLRAEDTAVYYCAG  (SEQ ID NO: 918)
RFTFSRDNAKNSAYLQMNSLRAEDTAVYYCAG  (SEQ ID NO: 919)
RFTFSRDNAKNSLYMQMNSLRAEDTAVYYCAG  (SEQ ID NO: 920)
RFTFSRDNAKNSLYLQLNSLRAEDTAVYYCAG  (SEQ ID NO: 921)
RFTISADTAKNSLYLQMNSLRAEDTAVYYCAG  (SEQ ID NO: 922)
RFTISADNAKNSAYLQMNSLRAEDTAVYYCAG  (SEQ ID NO: 923)
RFTISADNAKNSLYMQMNSLRAEDTAVYYCAG  (SEQ ID NO: 924)
RFTISADNAKNSLYLQLNSLRAEDTAVYYCAG  (SEQ ID NO: 925)
RFTISRDTAKNSAYLQMNSLRAEDTAVYYCAG  (SEQ ID NO: 926)
RFTISRDTAKNSLYMQMNSLRAEDTAVYYCAG  (SEQ ID NO: 927)
RFTISRDTAKNSLYLQLNSLRAEDTAVYYCAG  (SEQ ID NO: 928)
RFTISRDNAKNSAYMQMNSLRAEDTAVYYCAG  (SEQ ID NO: 929)
RFTISRDNAKNSAYLQLNSLRAEDTAVYYCAG  (SEQ ID NO: 930)
RFTISRDNAKNSLYMQLNSLRAEDTAVYYCAG  (SEQ ID NO: 931)
RATFSADNAKNSLYLQLNSLRAEDTAVYYCAG  (SEQ ID NO: 932)
RATFSRDTAKNSLYLQMNSLRAEDTAVYYCAG  (SEQ ID NO: 933)
RATFSRDNAKNSAYLQMNSLRAEDTAVYYCAG  (SEQ ID NO: 934)
RATFSRDNAKNSLYMQMNSLRAEDTAVYYCAG  (SEQ ID NO: 935)
RATFSRDNAKNSLYLQLNSLRAEDTAVYYCAG  (SEQ ID NO: 936)
RATISADTAKNSLYLQMNSLRAEDTAVYYCAG  (SEQ ID NO: 937)
RATISADNAKNSAYLQMNSLRAEDTAVYYCAG  (SEQ ID NO: 938)
RATISADNAKNSLYMQMNSLRAEDTAVYYCAG  (SEQ ID NO: 939)
RATISADNAKNSLYLQLNSLRAEDTAVYYCAG  (SEQ ID NO: 940)
RATISRDTAKNSAYLQMNSLRAEDTAVYYCAG  (SEQ ID NO: 941)
RATISRDTAKNSLYMQMNSLRAEDTAVYYCAG  (SEQ ID NO: 942)
RATISRDTAKNSLYLQLNSLRAEDTAVYYCAG  (SEQ ID NO: 943)
RATISRDNAKNSAYMQMNSLRAEDTAVYYCAG  (SEQ ID NO: 944)
RATISRDNAKNSAYLQLNSLRAEDTAVYYCAG  (SEQ ID NO: 945)
RATISRDNAKNSLYMQLNSLRAEDTAVYYCAG  (SEQ ID NO: 946)
RFTFSADTAKNSLYLQMNSLRAEDTAVYYCAG  (SEQ ID NO: 947)
RFTFSADNAKNSAYLQMNSLRAEDTAVYYCAG  (SEQ ID NO: 948)
```

TABLE 7-continued

Amino Acid Sequences derived from Murine 141A Antibody.

```
RFTFSADNAKNSLYMQMNSLRAEDTAVYYCAG (SEQ ID NO: 949)
RFTFSADNAKNSLYLQLNSLRAEDTAVYYCAG (SEQ ID NO: 950)
RFTFSRDTAKNSAYLQMNSLRAEDTAVYYCAG (SEQ ID NO: 951)
RFTFSRDTAKNSLYMQMNSLRAEDTAVYYCAG (SEQ ID NO: 952)
RFTFSRDTAKNSLYLQLNSLRAEDTAVYYCAG (SEQ ID NO: 953)
RFTFSRDNAKNSAYMQMNSLRAEDTAVYYCAG (SEQ ID NO: 954)
RFTFSRDNAKNSAYLQLNSLRAEDTAVYYCAG (SEQ ID NO: 955)
RFTFSRDNAKNSLYMQLNSLRAEDTAVYYCAG (SEQ ID NO: 956)
RFTISADTAKNSAYLQMNSLRAEDTAVYYCAG (SEQ ID NO: 957)
RFTISADTAKNSLYMQMNSLRAEDTAVYYCAG (SEQ ID NO: 958)
RFTISADTAKNSLYLQLNSLRAEDTAVYYCAG (SEQ ID NO: 959)
RFTISADNAKNSAYMQMNSLRAEDTAVYYCAG (SEQ ID NO: 960)
RFTISADNAKNSAYLQLNSLRAEDTAVYYCAG (SEQ ID NO: 961)
RFTISADNAKNSLYMQLNSLRAEDTAVYYCAG (SEQ ID NO: 962)
RFTISRDTAKNSAYMQMNSLRAEDTAVYYCAG (SEQ ID NO: 963)
RFTISRDTAKNSAYLQLNSLRAEDTAVYYCAG (SEQ ID NO: 964)
RFTISRDTAKNSLYMQLNSLRAEDTAVYYCAG (SEQ ID NO: 965)
RFTISRDNAKNSAYMQLNSLRAEDTAVYYCAG (SEQ ID NO: 966)
RATFSADTAKNSLYLQLNSLRAEDTAVYYCAG (SEQ ID NO: 967)
RATFSADTAKNSAYLQMNSLRAEDTAVYYCAG (SEQ ID NO: 968)
RATFSADNAKNSLYMQMNSLRAEDTAVYYCAG (SEQ ID NO: 969)
RATFSADNAKNSLYLQLNSLRAEDTAVYYCAG (SEQ ID NO: 970)
RATFSRDTAKNSAYLQMNSLRAEDTAVYYCAG (SEQ ID NO: 971)
RATFSRDTAKNSLYMQMNSLRAEDTAVYYCAG (SEQ ID NO: 972)
RATFSRDTAKNSLYLQLNSLRAEDTAVYYCAG (SEQ ID NO: 973)
RATFSRDNAKNSAYMQMNSLRAEDTAVYYCAG (SEQ ID NO: 974)
RATFSRDNAKNSAYLQLNSLRAEDTAVYYCAG (SEQ ID NO: 975)
RATFSRDNAKNSLYMQLNSLRAEDTAVYYCAG (SEQ ID NO: 976)
RATISADTAKNALYLQMNSLRAEDTAVYYCAG (SEQ ID NO: 977)
RATISADTAKNSLYMQMNSLRAEDTAVYYCAG (SEQ ID NO: 978)
RATISADTAKNSLYLQLNSLRAEDTAVYYCAG (SEQ ID NO: 979)
RATISADNAKNSAYMQMNSLRAEDTAVYYCAG (SEQ ID NO: 980)
RATISADNAKNSAYLQLNSLRAEDTAVYYCAG (SEQ ID NO: 981)
RATISADNAKNSLYMQLNSLRAEDTAVYYCAG (SEQ ID NO: 982)
RATISRDTAKNSAYMQLNSLRAEDTAVYYCAG (SEQ ID NO: 983)
RATISRDTAKNSAYMQMNSLRAEDTAVYYCAG (SEQ ID NO: 984)
RATISRDTAKNSLYMQLNSLRAEDTAVYYCAG (SEQ ID NO: 985)
RATISRDNAKNSAYMQLNSLRAEDTAVYYCAG (SEQ ID NO: 986)
RFTFSADTAKNSAYLQMNSLRAEDTAVYYCAG (SEQ ID NO: 987)
RFTFSADTAKNSLYMQMNSLRAEDTAVYYCAG (SEQ ID NO: 988)
RFTFSADTAKNSLYLQLNSLRAEDTAVYYCAG (SEQ ID NO: 989)
RFTFSADNAKNSAYMQMNSLRAEDTAVYYCAG (SEQ ID NO: 990)
RFTFSADNAKNSAYLQLNSLRAEDTAVYYCAG (SEQ ID NO: 991)
RFTFSADNAKNSLYMQLNSLRAEDTAVYYCAG (SEQ ID NO: 992)
RFTFSRDTAKNSAYMQMNSLRAEDTAVYYCAG (SEQ ID NO: 993)
RFTFSRDTAKNSAYLQLNSLRAEDTAVYYCAG (SEQ ID NO: 994)
RFTFSRDTAKNSLYMQLNSLRAEDTAVYYCAG (SEQ ID NO: 995)
RFTFSRDNAKNSAYMQLNSLRAEDTAVYYCAG (SEQ ID NO: 996)
RFTISADTAKNSAYMQMNSLRAEDTAVYYCAG (SEQ ID NO: 997)
RFTISADTAKNSAYLQLNSLRAEDTAVYYCAG (SEQ ID NO: 998)
RFTISADTAKNSLYMQLNSLRAEDTAVYYCAG (SEQ ID NO: 999)
RFTISADNAKNSAYMQLNSLRAEDTAVYYCAG (SEQ ID NO: 1000)
RFTISRDTAKNSAYMQLNSLRAEDTAVYYCAG (SEQ ID NO: 1001)
RATFSADTAKNSAYLQMNSLRAEDTAVYYCAG (SEQ ID NO: 1002)
RATFSADTAKNSLYMQMNSLRAEDTAVYYCAG (SEQ ID NO: 1003)
RATFSADTAKNSLYLQLNSLRAEDTAVYYCAG (SEQ ID NO: 1004)
RATFSADNAKNSAYMQMNSLRAEDTAVYYCAG (SEQ ID NO: 1005)
RATFSADNAKNSAYLQLNSLRAEDTAVYYCAG (SEQ ID NO: 1006)
RATFSADNAKNSLYMQLNSLRAEDTAVYYCAG (SEQ ID NO: 1007)
RATFSRDTAKNSAYMQMNSLRAEDTAVYYCAG (SEQ ID NO: 1008)
RATFSRDTAKNSAYLQLNSLRAEDTAVYYCAG (SEQ ID NO: 1009)
RATFSRDTAKNSLYMQLNSLRAEDTAVYYCAG (SEQ ID NO: 1010)
RATFSRDNAKNSAYMQLNSLRAEDTAVYYCAG (SEQ ID NO: 1011)
RATISADTAKNALYMQMNSLRAEDTAVYYCAG (SEQ ID NO: 1012)
RATISADTAKNALYLQLNSLRAEDTAVYYCAG (SEQ ID NO: 1013)
RATISADTAKNSLYMQLNSLRAEDTAVYYCAG (SEQ ID NO: 1014)
RATISADNAKNSAYMQLNSLRAEDTAVYYCAG (SEQ ID NO: 1015)
RATISRDTAKNSAYMQLNSLRAEDTAVYYCAG (SEQ ID NO: 1016)
RFTFSADTAKNSAYMQMNSLRAEDTAVYYCAG (SEQ ID NO: 1017)
RFTFSADTAKNSAYLQLNSLRAEDTAVYYCAG (SEQ ID NO: 1018)
RFTFSADTAKNSLYMQLNSLRAEDTAVYYCAG (SEQ ID NO: 1019)
RFTFSADNAKNSAYMQLNSLRAEDTAVYYCAG (SEQ ID NO: 1020)
RFTFSRDTAKNSAYMQLNSLRAEDTAVYYCAG (SEQ ID NO: 1021)
RFTISADTAKNSAYMQLNSLRAEDTAVYYCAG (SEQ ID NO: 1022)
RATFSADTAKNSAYMQMNSLRAEDTAVYYCAG (SEQ ID NO: 1023)
RATFSADTAKNSAYLQLNSLRAEDTAVYYCAG (SEQ ID NO: 1024)
RATFSADTAKNSLYMQLNSLRAEDTAVYYCAG (SEQ ID NO: 1025)
RATFSADNAKNSAYMQLNSLRAEDTAVYYCAG (SEQ ID NO: 1026)
RATFSRDTAKNSAYMQLNSLRAEDTAVYYCAG (SEQ ID NO: 1027)
RATISADTAKNALYMQLNSLRAEDTAVYYCAG (SEQ ID NO: 1028)
RFTFSADTAKNSAYMQLNSLRAEDTAVYYCAG (SEQ ID NO: 1029)
RATFSADTAKNSAYMQLNSLRAEDTAVYYCAG (SEQ ID NO: 1030)
```

141A-huVH3b VH CDR3
EEVYDGYPWFGY (SEQ ID NO: 35)
EEVYEGYPWFGY (SEQ ID NO: 883)
EEVYSGYPWFGY (SEQ ID NO: 884)
EEVYAGYPWFGY (SEQ ID NO: 885)

141A-huVH3b VH FR4
WGQGTLVTVSS (SEQ ID NO: 54)

141A HUMANIZED ANTIBODY SEQUENCE: LIGHT CHAIN
141A-huVK3 Variable Region
EIVLTQSPGTLSLSPGERATLSCRASSSLSYMHWYQQKPGQAPRLLIY**AT
SNLASGIPDRFSGSGSGTDFTLTISRLEPEDFAVYYCQQWSSNPYT**FGQ
GTKLEIK (SEQ ID NO: 26)

141A-huVK3 VL FR1
EIVLTQSPGTLSLSPGERATLSC (SEQ ID NO: 91)
EIVLTQSPGTLSASPGERATLSC (SEQ ID NO: 1031)
EIVLTQSPGTLSLSPGERVTLSC (SEQ ID NO: 1032)
EIVLTQSPGTLSLSPGERATMSC (SEQ ID NO: 1033)
EIVLTQSPGTLSASPGERVTLSC (SEQ ID NO: 1034)
EIVLTQSPGTLSASPGERATMSC (SEQ ID NO: 1035)
EIVLTQSPGTLSLSPGERVTMSC (SEQ ID NO: 1036)
EIVLTQSPGTLSASPGERVTMSC (SEQ ID NO: 1037)

141A-huVK3 VL CDR1
RASSSLSYMH (SEQ ID NO: 42)

141A-huVK3 VL FR2
WYQQKPGQAPRLLIY (SEQ ID NO: 92)
WYQQKPGQSPRLLIY (SEQ ID NO: 1038)
WYQQKPGQAPRPLIY (SEQ ID NO: 1039)
WYQQKPGQAPRLWIY (SEQ ID NO: 1040)
WYQQKPGQSPRPLIY (SEQ ID NO: 1041)
WYQQKPGQSPRLWIY (SEQ ID NO: 1042)
WYQQKPGQAPRPWIY (SEQ ID NO: 1043)
WYQQKPGQSPRPWIY (SEQ ID NO: 1044)

141A-huVK3 VL CDR2
ATSNLAS (SEQ ID NO: 43)
ATSQLAS (SEQ ID NO: 1045)
ATSSLAS (SEQ ID NO: 1046)
ATSDLAS (SEQ ID NO: 1047)
ATSALAS (SEQ ID NO: 1048)

141A-huVK3 VL FR3
GIPDRFSGSGSGTDFTLTISRLEPEDFAVYYC (SEQ ID NO: 93)
GVPDRFSGSGSGTDFTLTISRLEPEDFAVYYC (SEQ ID NO: 1049)
GIPDRFSGSGSGTDYTLTISRLEPEDFAVYYC (SEQ ID NO: 1050)
GIPDRFSGSGSGTDFTLTISRVEPEDFAVYYC (SEQ ID NO: 1051)
GVPDRFSGSGSGTDYTLTISRLEPEDFAVYYC (SEQ ID NO: 1052)
GVPDRFSGSGSGTDFTLTISRVEPEDFAVYYC (SEQ ID NO: 1053)
GIPDRFSGSGSGTDYTLTISRVEPEDFAVYYC (SEQ ID NO: 1054)
GVPDRFSGSGSGTDYTLTISRVEPEDFAVYYC (SEQ ID NO: 1055)

141A-huVK3 VL CDR3
QQWSSNPYT (SEQ ID NO: 44)
QQWSSQPYT (SEQ ID NO: 1056)
QQWSSSPYT (SEQ ID NO: 1057)
QQWSSAPYT (SEQ ID NO: 1058)

141A-huVK3 VL FR4
FGQGTKLEIK (SEQ ID NO: 78)

141A-huVK1 Variable Region
DIQMTQSPSSLSASVGDRVTITCRASSSLSYMHWYQQKPGKAPKLLIY**AT
SNLASGVPSRFSGSGSGTDFTLTISSLQPEDFATYYCQQWSSNPYT**FGQ
GTKLEIK (SEQ ID NO: 27)

141A-huVK1 VL FR1
DIQMTQSPSSLSASVGDRVTITC (SEQ ID NO: 79)

TABLE 7-continued

Amino Acid Sequences derived from Murine 141A Antibody.

DIQLTQSPSSLSASVGDRVTITC (SEQ ID NO: 1059)
DIQMTQSPSSLSASVGDRVTMTC (SEQ ID NO: 1060)
DIQLTQSPSSLSASVGDRVTMTC (SEQ ID NO: 1061)

141A-huVK1 VL CDR1
RASSSLSYMH (SEQ ID NO: 42)

141A-huVK1 VL FR2
WYQQKPGKAPKLLIY (SEQ ID NO: 80)
WYQQKPGKSPKLLIY (SEQ ID NO: 284)
WYQQKPGKAPKPLIY (SEQ ID NO: 1062)
WYQQKPGKAPKLWIY (SEQ ID NO: 1063)
WYQQKPGKSPKPLIY (SEQ ID NO: 1064)
WYQQKPGKSPKLWIY (SEQ ID NO: 1065)
WYQQKPGKAPKPWIY (SEQ ID NO: 1066)
WYQQKPGKSPKPWIY (SEQ ID NO: 1067)

141A-huVK1 VL CDR2
ATSNLAS (SEQ ID NO: 43)
ATSQLAS (SEQ ID NO: 1045)
ATSSLAS (SEQ ID NO: 1046)
ATSDLAS (SEQ ID NO: 1047)
ATSALAS (SEQ ID NO: 1048)

141A-huVK1 VL FR3
GVPSRFSGSGSGTDFTLTISSLQPEDFATYYC (SEQ ID NO: 81)
GVPSRFSGSGSGTDYTLTISSLQPEDFATYYC (SEQ ID NO: 1068)
GVPSRFSGSGSGTDFTLTISSVQPEDFATYYC (SEQ ID NO: 285)
GVPSRFSGSGSGTDYTLTISSVQPEDFATYYC (SEQ ID NO: 1069)

141A-huVK1 VL CDR3
QQWSSNPYT (SEQ ID NO: 44)
QQWSSQPYT (SEQ ID NO: 1056)
QQWSSSPYT (SEQ ID NO: 1057)
QQWSSAPYT (SEQ ID NO: 1058)

141A-huVK1 VL FR4
FGQGTKLEIK (SEQ ID NO: 78)

*Amino acid position numbering as in Kabat.

TABLE 8

Amino Acid Sequences derived from Murine 26A Antibody.

26A HUMANIZED ANTIBODY SEQUENCE: HEAVY CHAIN
h26AH1 Variable Region
QVQLVQSGAEVKKPGASVKVSCKASGFSFTGYTMNWVRQAPGQGLEWMGLISPYNGGTSYAQKFQGRVTMTRDTSTSTVYMELSSLRSEDTAVYYCARRAYGYAMDYWGQGTLVTVSS (SEQ ID NO: 1529)

h26A VH FR1
QVQLVQSGAEVKKPGASVKVSCKAS (SEQ ID NO: 51)
QVQLVQSGAEVVKPGASVKVSCKAS (SEQ ID NO: 1550)
QVQLVQSGAEVKKPGASMKVSCKAS (SEQ ID NO: 1551)
QVQLVQSGAEVKKPGASVKISCKAS (SEQ ID NO: 105)
QVQLVQSGAEVVKPGASMKVSCKAS (SEQ ID NO: 1552)
QVQLVQSGAEVVKPGASVKISCKAS (SEQ ID NO: 1553)
QVQLVQSGAEVKKPGASMKISCKAS (SEQ ID NO: 1554)
QVQLVQSGAEVVKPGASMKISCKAS (SEQ ID NO: 1555)

h26A VH CDR1
GFSFTGYTMN (SEQ ID NO: 1296)

h26A VH FR2
WVRQAPGQGLEWMG (SEQ ID NO: 52)
WVRQAPGQGLEWIG (SEQ ID NO: 106)

h26A VH CDR2
LISPYNGGTS (SEQ ID NO: 1358)
LISPYQGGTS (SEQ ID NO: 1556)
LISPYSGGTS (SEQ ID NO: 1557)
LISPYAGGTS (SEQ ID NO: 1558)
LISPYDGGTS (SEQ ID NO: 1559)

TABLE 8-continued

Amino Acid Sequences derived from Murine 26A Antibody.

h26A VH FR3
YAQKFQGRVTMTRDTSTSTVYMELSSLRSEDTAVYYCAR (SEQ ID NO: 1560)
YNQKFQGRVTMTRDTSTSTVYMELSSLRSEDTAVYYCAR (SEQ ID NO: 1561)
YAQKFQGRATMTRDTSTSTVYMELSSLRSEDTAVYYCAR (SEQ ID NO: 1562)
YAQKFQGRVTLTRDTSTSTVYMELSSLRSEDTAVYYCAR (SEQ ID NO: 1563)
YAQKFQGRVTMTVDTSTSTVYMELSSLRSEDTAVYYCAR (SEQ ID NO: 1564)
YAQKFQGRVTMTRDKSTSTVYMELSSLRSEDTAVYYCAR (SEQ ID NO: 1565)
YAQKFQGRVTMTRDTSTSTAYMELSSLRSEDTAVYYCAR (SEQ ID NO: 1566)
YNQKFQGRATMTRDTSTSTVYMELSSLRSEDTAVYYCAR (SEQ ID NO: 1567)
YNQKFQGRVTLTRDTSTSTVYMELSSLRSEDTAVYYCAR (SEQ ID NO: 1568)
YNQKFQGRVTMTVDTSTSTVYMELSSLRSEDTAVYYCAR (SEQ ID NO: 1569)
YNQKFQGRVTMTRDKSTSTVYMELSSLRSEDTAVYYCAR (SEQ ID NO: 1570)
YNQKFQGRVTMTRDTSTSTAYMELSSLRSEDTAVYYCAR (SEQ ID NO: 1571)
YAQKFQGRATLTRDTSTSTVYMELSSLRSEDTAVYYCAR (SEQ ID NO: 1572)
YAQKFQGRATMTVDTSTSTVYMELSSLRSEDTAVYYCAR (SEQ ID NO: 1573)
YAQKFQGRATMTRDKSTSTVYMELSSLRSEDTAVYYCAR (SEQ ID NO: 1574)
YAQKFQGRATMTRDTSTSTAYMELSSLRSEDTAVYYCAR (SEQ ID NO: 1575)
YAQKFQGRVTLTVDTSTSTVYMELSSLRSEDTAVYYCAR (SEQ ID NO: 1576)
YAQKFQGRVTLTRDKSTSTVYMELSSLRSEDTAVYYCAR (SEQ ID NO: 1577)
YAQKFQGRVTLTRDTSTSTAYMELSSLRSEDTAVYYCAR (SEQ ID NO: 1578)
YAQKFQGRVTMTVDKSTSTVYMELSSLRSEDTAVYYCAR (SEQ ID NO: 1579)
YAQKFQGRVTMTVDTSTSTAYMELSSLRSEDTAVYYCAR (SEQ ID NO: 1580)
YAQKFQGRVTMTRDKSTSTAYMELSSLRSEDTAVYYCAR (SEQ ID NO: 1581)
YNQKFQGRATLTRDTSTSTVYMELSSLRSEDTAVYYCAR (SEQ ID NO: 1582)
YNQKFQGRATMTVDTSTSTVYMELSSLRSEDTAVYYCAR (SEQ ID NO: 1583)
YNQKFQGRATMTRDKSTSTVYMELSSLRSEDTAVYYCAR (SEQ ID NO: 1584)
YNQKFQGRATMTRDTSTSTAYMELSSLRSEDTAVYYCAR (SEQ ID NO: 1585)
YNQKFQGRVTLTVDTSTSTVYMELSSLRSEDTAVYYCAR (SEQ ID NO: 1586)
YNQKFQGRVTLTRDKSTSTVYMELSSLRSEDTAVYYCAR (SEQ ID NO: 1587)
YNQKFQGRVTLTRDTSTSTAYMELSSLRSEDTAVYYCAR (SEQ ID NO: 1588)
YNQKFQGRVTMTVDKSTSTVYMELSSLRSEDTAVYYCAR (SEQ ID NO: 1589)
YNQKFQGRVTMTVDTSTSTAYMELSSLRSEDTAVYYCAR (SEQ ID NO: 1590)
YNQKFQGRVTMTRDKSTSTAYMELSSLRSEDTAVYYCAR (SEQ ID NO: 1591)
YAQKFQGRATLTVDTSTSTVYMELSSLRSEDTAVYYCAR (SEQ ID NO: 1592)
YAQKFQGRATLTRDKSTSTVYMELSSLRSEDTAVYYCAR (SEQ ID NO: 1593)
YAQKFQGRATLTRDTSTSTAYMELSSLRSEDTAVYYCAR (SEQ ID NO: 1594)
YAQKFQGRATMTVDKSTSTVYMELSSLRSEDTAVYYCAR (SEQ ID NO: 1595)
YAQKFQGRATMTVDTSTSTAYMELSSLRSEDTAVYYCAR (SEQ ID NO: 1596)

TABLE 8-continued

Amino Acid Sequences derived from Murine 26A Antibody.

YAQKFQGRATMTRDKSTSTAYMELSSLRSEDTAVYYCAR (SEQ ID NO: 1597)
YAQKFQGRVTLTVDKSTSTVYMELSSLRSEDTAVYYCAR (SEQ ID NO: 1598)
YAQKFQGRVTLTVDTSTSTAYMELSSLRSEDTAVYYCAR (SEQ ID NO: 1599)
YAQKFQGRVTMTVDKSTSTAYMELSSLRSEDTAVYYCAR (SEQ ID NO: 1600)
YNQKFQGRATLTVDTSTSTVYMELSSLRSEDTAVYYCAR (SEQ ID NO: 1601)
YNQKFQGRATLTRDKSTSTVYMELSSLRSEDTAVYYCAR (SEQ ID NO: 1602)
YNQKFQGRATLTRDTSTSTAYMELSSLRSEDTAVYYCAR (SEQ ID NO: 1603)
YNQKFQGRVTLTVDKSTSTVYMELSSLRSEDTAVYYCAR (SEQ ID NO: 1604)
YNQKFQGRVTLTVDTSTSTAYMELSSLRSEDTAVYYCAR (SEQ ID NO: 1605)
YNQKFQGRVTMTVDKSTSTAYMELSSLRSEDTAVYYCAR (SEQ ID NO: 1606)
YAQKFQGRATLTVDKSTSTVYMELSSLRSEDTAVYYCAR (SEQ ID NO: 1607)
YAQKFQGRATLTVDTSTSTAYMELSSLRSEDTAVYYCAR (SEQ ID NO: 1608)
YAQKFQGRATMTVDKSTSTAYMELSSLRSEDTAVYYCAR (SEQ ID NO: 1609)
YAQKFQGRVTLTVDKSTSTAYMELSSLRSEDTAVYYCAR (SEQ ID NO: 1610)
YNQKFQGRATLTVDKSTSTAYMELSSLRSEDTAVYYCAR (SEQ ID NO: 1611)
YNQKFQGRATLTVDTSTSTAYMELSSLRSEDTAVYYCAR (SEQ ID NO: 1612)
YAQKFQGRATLTVDKSTSTAYMELSSLRSEDTAVYYCAR (SEQ ID NO: 1613)
YNQKFQGRATLTVDKSTSTAYMELSSLRSEDTAVYYCAR (SEQ ID NO: 1614)

h26A VH CDR3
RAYGYAMDY (SEQ ID NO: 1393)

h26A VH FR4
WGQGTLVTVSS (SEQ ID NO: 54)

26A HUMANIZED ANTIBODY SEQUENCE: LIGHT CHAIN
h26AL1 Variable Region
EIVLTQSPATLSLSPGERATLSCSASSSVSYMYWYQQKPGQAPRLLIYDTSNLASGIPARFSGSGSGTDFTLTISSLEPEDFAVYYCQQWSSYPFTFGQGTKLEIK (SEQ ID NO: 1532)

h26A VL FR1
EIVLTQSPATLSLSPGERATLSC (SEQ ID NO: 1615)
EIVLTQSPATMSLSPGERATLSC (SEQ ID NO: 1616)
EIVLTQSPATLSASPGERATLSC (SEQ ID NO: 1617)
EIVLTQSPATLSLSPGERVTLSC (SEQ ID NO: 1618)
EIVLTQSPATLSLSPGERATMSC (SEQ ID NO: 1619)
EIVLTQSPATMSASPGERATLSC (SEQ ID NO: 1620)
EIVLTQSPATMSLSPGERVTLSC (SEQ ID NO: 1621)
EIVLTQSPATMSLSPGERATMSC (SEQ ID NO: 1622)
EIVLTQSPATLSASPGERVTLSC (SEQ ID NO: 1623)
EIVLTQSPATLSASPGERATMSC (SEQ ID NO: 1624)
EIVLTQSPATLSLSPGERVTMSC (SEQ ID NO: 1625)
EIVLTQSPATMSASPGERVTLSC (SEQ ID NO: 1626)
EIVLTQSPATMSASPGERATMSC (SEQ ID NO: 1627)
EIVLTQSPATLSASPGERVTMSC (SEQ ID NO: 1628)
EIVLTQSPATMSASPGERVTMSC (SEQ ID NO: 1629)

h26A VL CDR1
SASSSVSYMY (SEQ ID NO: 1435)

h26A VL FR2
WYQQKPGQAPRLLIY (SEQ ID NO: 92)

h26A VL CDR2
DTSNLAS (SEQ ID NO: 1476)
DTSQLAS (SEQ ID NO: 1630)
DTSSLAS (SEQ ID NO: 1631)
DTSALAS (SEQ ID NO: 1632)
DTSDLAS (SEQ ID NO: 1633)

h26A VL FR3
GIPARFSGSGSGTDFTLTISSLEPEDFAVYYC (SEQ ID NO: 1634)
GVPARFSGSGSGTDFTLTISSLEPEDFAVYYC (SEQ ID NO: 1635)
GIPARFSGSGSGTDYTLTISSLEPEDFAVYYC (SEQ ID NO: 1636)
GIPARFSGSGSGTDFTLTISSMEPEDFAVYYC (SEQ ID NO: 1637)
GIPARFSGSGSGTDFTLTISSLEPEDAAVYYC (SEQ ID NO: 1638)
GVPARFSGSGSGTDYTLTISSLEPEDFAVYYC (SEQ ID NO: 1639)
GVPARFSGSGSGTDFTLTISSMEPEDFAVYYC (SEQ ID NO: 1640)
GVPARFSGSGSGTDFTLTISSLEPEDAAVYYC (SEQ ID NO: 1641)
GIPARFSGSGSGTDYTLTISSMEPEDFAVYYC (SEQ ID NO: 1642)
GIPARFSGSGSGTDYTLTISSLEPEDAAVYYC (SEQ ID NO: 1643)
GIPARFSGSGSGTDFTLTISSMEPEDAAVYYC (SEQ ID NO: 1644)
GVPARFSGSGSGTDYTLTISSMEPEDFAVYYC (SEQ ID NO: 1645)
GVPARFSGSGSGTDYTLTISSLEPEDAAVYYC (SEQ ID NO: 1646)
GIPARFSGSGSGTDYTLTISSMEPEDAAVYYC (SEQ ID NO: 1647)
GVPARFSGSGSGTDYTLTISSMEPEDAAVYYC (SEQ ID NO: 1648)

h26A VL CDR3
QQWSSYPFT (SEQ ID NO: 1499)

h26A VL FR4
FGQGTKLEIK (SEQ ID NO: 78)

TABLE 9

Amino Acid Sequences derived from Murine 128A Antibody.

128A HUMANIZED ANTIBODY SEQUENCE: HEAVY CHAIN
h128AH1 Variable Region
QVQLVQSGAEVKKPGASVKVSCKASGYTFTDYGMHWVRQAPGQGLEWMGLIDTYYGDATYAQKFQGRVTMTRDTSTSTVYMELSSLRSEDTAVYYCARRAGNAMDYWGQGTLVTVSS (SEQ ID NO: 1535)

h128A VH FR1
QVQLVQSGAEVKKPGASVKVSCKAS (SEQ ID NO: 51)
QVQLVQSGAEVVKPGASVKVSCKAS (SEQ ID NO: 1550)
QVQLVQSGAEVKKPGASVKISCKAS (SEQ ID NO: 105)
QVQLVQSGAEVKKPGASVKVSCKGS (SEQ ID NO: 1649)
QVQLVQSGAEVVKPGASVKISCKAS (SEQ ID NO: 1553)
QVQLVQSGAEVVKPGASVKVSCKGS (SEQ ID NO: 1650)
QVQLVQSGAEVKKPGASVKISCKGS (SEQ ID NO: 1651)
QVQLVQSGAEVVKPGASVKISCKGS (SEQ ID NO: 1652)

h128A VH CDR1
GYTFTDYGMH (SEQ ID NO: 1291)

h128A VH FR2
WVRQAPGQGLEWMG (SEQ ID NO: 52)
WVRQAPGQGLEWIG (SEQ ID NO: 106)

h128A VH CDR2
LIDTYYGDAT (SEQ ID NO: 1350)

h128A VH FR3
YAQKFQGRVTMTRDTSTSTVYMELSSLRSEDTAVYYCAR (SEQ ID NO: 1560)
YNQKFQGRVTMTRDTSTSTVYMELSSLRSEDTAVYYCAR (SEQ ID NO: 1561)
YAQKFQGRATMTRDTSTSTVYMELSSLRSEDTAVYYCAR (SEQ ID NO: 1562)
YAQKFQGRVTMTVDTSTSTVYMELSSLRSEDTAVYYCAR (SEQ ID NO: 1564)
YAQKFQGRVTMTRDKSTSTVYMELSSLRSEDTAVYYCAR (SEQ ID NO: 1565)
YAQKFQGRVTMTRDTSTSTAYMELSSLRSEDTAVYYCAR (SEQ ID NO: 1566)
YAQKFQGRVTMTRDTSTSTVYMELSSLRSEDTAIYYCAR (SEQ ID NO: 1653)
YNQKFQGRATMTRDTSTSTVYMELSSLRSEDTAVYYCAR (SEQ ID NO: 1567)
YNQKFQGRVTMTVDTSTSTVYMELSSLRSEDTAVYYCAR (SEQ ID NO: 1569)

TABLE 9-continued

Amino Acid Sequences derived from Murine 128A Antibody.

YNQKFQGRVTMTRDKSTSTVYMELSSLRSEDTAVYYCAR (SEQ ID NO: 1570)
YNQKFQGRVTMTRDTSTSTAYMELSSLRSEDTAVYYCAR (SEQ ID NO: 1571)
YNQKFQGRVTMTRDTSTSTAYMELSSLRSEDTAIYYCAR (SEQ ID NO: 1654)
YAQKFQGRATMTVDTSTSTVYMELSSLRSEDTAVYYCAR (SEQ ID NO: 1573)
YAQKFQGRATMTRDKSTSTVYMELSSLRSEDTAVYYCAR (SEQ ID NO: 1574)
YAQKFQGRATMTRDTSTSTAYMELSSLRSEDTAVYYCAR (SEQ ID NO: 1575)
YAQKFQGRATMTRDTSTSTAYMELSSLRSEDTAIYYCAR (SEQ ID NO: 1655)
YAQKFQGRVTMTVDKSTSTVYMELSSLRSEDTAVYYCAR (SEQ ID NO: 1579)
YAQKFQGRVTMTVDTSTSTAYMELSSLRSEDTAVYYCAR (SEQ ID NO: 1580)
YAQKFQGRVTMTVDTSTSTVYMELSSLRSEDTAIYYCAR (SEQ ID NO: 1656)
YAQKFQGRVTMTRDKSTSTAYMELSSLRSEDTAVYYCAR (SEQ ID NO: 1581)
YAQKFQGRVTMTRDKSTSTAYMELSSLRSEDTAIYYCAR (SEQ ID NO: 1657)
YAQKFQGRVTMTRDTSTSTAYMELSSLRSEDTAIYYCAR (SEQ ID NO: 1658)
YNQKFQGRATMTVDTSTSTVYMELSSLRSEDTAVYYCAR (SEQ ID NO: 1583)
YNQKFQGRATMTRDKSTSTVYMELSSLRSEDTAVYYCAR (SEQ ID NO: 1584)
YNQKFQGRATMTRDTSTSTAYMELSSLRSEDTAVYYCAR (SEQ ID NO: 1585)
YNQKFQGRATMTRDTSTSTAYMELSSLRSEDTAIYYCAR (SEQ ID NO: 1659)
YNQKFQGRVTMTVDKSTSTAYMELSSLRSEDTAVYYCAR (SEQ ID NO: 1589)
YNQKFQGRVTMTVDTSTSTAYMELSSLRSEDTAVYYCAR (SEQ ID NO: 1590)
YNQKFQGRVTMTVDTSTSTAYMELSSLRSEDTAIYYCAR (SEQ ID NO: 1660)
YNQKFQGRVTMTRDKSTSTAYMELSSLRSEDTAVYYCAR (SEQ ID NO: 1591)
YNQKFQGRVTMTRDKSTSTAYMELSSLRSEDTAIYYCAR (SEQ ID NO: 1661)
YNQKFQGRVTMTRDTSTSTAYMELSSLRSEDTAIYYCAR (SEQ ID NO: 1662)
YAQKFQGRATMTVDKSTSTAYMELSSLRSEDTAVYYCAR (SEQ ID NO: 1595)
YAQKFQGRATMTVDTSTSTAYMELSSLRSEDTAVYYCAR (SEQ ID NO: 1596)
YAQKFQGRATMTVDTSTSTAYMELSSLRSEDTAIYYCAR (SEQ ID NO: 1663)
YAQKFQGRATMTRDKSTSTAYMELSSLRSEDTAVYYCAR (SEQ ID NO: 1597)
YAQKFQGRATMTRDTSTSTAYMELSSLRSEDTAIYYCAR (SEQ ID NO: 1664)
YAQKFQGRATMTRDTSTSTAYMELSSLRSEDTAIYYCAR (SEQ ID NO: 1665)
YAQKFQGRVTMTVDKSTSTAYMELSSLRSEDTAVYYCAR (SEQ ID NO: 1600)
YAQKFQGRVTMTVDKSTSTAYMELSSLRSEDTAIYYCAR (SEQ ID NO: 1666)
YAQKFQGRVTMTRDKSTSTAYMELSSLRSEDTAIYYCAR (SEQ ID NO: 1667)
YNQKFQGRVTMTVDKSTSTAYMELSSLRSEDTAVYYCAR (SEQ ID NO: 1668)
YNQKFQGRATMTVDTSTSTAYMELSSLRSEDTAVYYCAR (SEQ ID NO: 1669)
YNQKFQGRATMTVDTSTSTAYMELSSLRSEDTAIYYCAR (SEQ ID NO: 1670)
YNQKFQGRVTMTVDKSTSTVYMELSSLRSEDTAVYYCAR (SEQ ID NO: 1606)
YNQKFQGRVTMTVDKSTSTAYMELSSLRSEDTAIYYCAR (SEQ ID NO: 1671)
YNQKFQGRVTMTRDKSTSTAYMELSSLRSEDTAIYYCAR (SEQ ID NO: 1672)
YAQKFQGRATMTVDKSTSTAYMELSSLRSEDTAVYYCAR (SEQ ID NO: 1609)
YAQKFQGRATMTVDKSTSTVYMELSSLRSEDTAIYYCAR (SEQ ID NO: 1673)
YAQKFQGRATMTRDKSTSTAYMELSSLRSEDTAIYYCAR (SEQ ID NO: 1674)
YAQKFQGRVTMTVDKSTSTAYMELSSLRSEDTAIYYCAR (SEQ ID NO: 1675)
YNQKFQGRATMTVDKSTSTAYMELSSLRSEDTAVYYCAR (SEQ ID NO: 1676)
YNQKFQGRATMTVDKSTSTVYMELSSLRSEDTAAYYCAR (SEQ ID NO: 1677)
YAQKFQGRATMTVDKSTSTAYMELSSLRSEDTAAYYCAR (SEQ ID NO: 1678)
YNQKFQGRATMTVDKSTSTAYMELSSLRSEDTAAYYCAR (SEQ ID NO: 1679)

h128A VH CDR3
RAGNAMDY (SEQ ID NO: 1385)

h128A VH FR4
WGQGTLVTVSS (SEQ ID NO: 54)
WGQGTLVTASS (SEQ ID NO: 1680)

128A HUMANIZED ANTIBODY SEQUENCE: LIGHT CHAIN
h128AL1 Variable Region
DIQMTQSPSSLSASVGDRVTITCKASQSVSNDIAWYQQKPGKAPKLLIYYASNRYTGVPSRFSGSGSGTDFTLTISSLQPEDFATYYCQQDYSSPRTFGQGTKLEIK (SEQ ID NO: 1538)

h128A VL FR1
DIQMTQSPSSLSASVGDRVTITC (SEQ ID NO: 79)
DIQMTQSPSSLSVSVGDRVTITC (SEQ ID NO: 278)

h128A VL CDR1
KASQSVSNDIA (SEQ ID NO: 1429)
KASQSVSQDIA (SEQ ID NO: 1681)
KASQSVSSDIA (SEQ ID NO: 1682)
KASQSVSADIA (SEQ ID NO: 1683)
KASQSVSDDIA (SEQ ID NO: 1684)

h128A VL FR2
WYQQKPGKAPKLLIY (SEQ ID NO: 80)
WYQQKPGKSPKLLIY (SEQ ID NO: 284)

h128A VL CDR2
YASNRYT (SEQ ID NO: 1473)
YASQRYT (SEQ ID NO: 1685)
YASSRYT (SEQ ID NO: 1686)
YASARYT (SEQ ID NO: 1687)
YASDRYT (SEQ ID NO: 1688)

h128A VL FR3
GVPSRFSGSGSGTDFTLTISSLQPEDFATYYC (SEQ ID NO: 81)
GVPSRFSGSGYGTDFTLTISSLQPEDFATYYC (SEQ ID NO: 1689)
GVPSRFSGSGSGTDFFTISSLQPEDFATYYC (SEQ ID NO: 1690)
GVPSRFSGSGSGTDFTLTISSVQPEDFATYYC (SEQ ID NO: 285)
GVPSRFSGSGSGTDFTLTISSLQPEDLATYYC (SEQ ID NO: 286)
GVPSRFSGSGSGTDFTLTISSLQPEDFATYFC (SEQ ID NO: 1691)
GVPSRFSGSGYGTDFFTISSLQPEDFATYYC (SEQ ID NO: 1692)
GVPSRFSGSGYGTDFTLTISSVQPEDFATYYC (SEQ ID NO: 1693)
GVPSRFSGSGYGTDFTLTISSLQPEDLATYYC (SEQ ID NO: 1694)
GVPSRFSGSGYGTDFFTISSLQPEDFATYFC (SEQ ID NO: 1695)
GVPSRFSGSGSGTDFFTISSVQPEDFATYYC (SEQ ID NO: 1696)
GVPSRFSGSGSGTDFFTISSLQPEDLATYYC (SEQ ID NO: 1697)
GVPSRFSGSGSGTDFFTISSLQPEDFATYFC (SEQ ID NO: 1698)
GVPSRFSGSGSGTDFTLTISSVQPEDLATYYC (SEQ ID NO: 288)
GVPSRFSGSGSGTDFTLTISSVQPEDFATYFC (SEQ ID NO: 1699)
GVPSRFSGSGSGTDFTLTISSLQPEDLATYFC (SEQ ID NO: 1700)
GVPSRFSGSGYGTDFFTISSVQPEDFATYYC (SEQ ID NO: 1701)
GVPSRFSGSGYGTDFFTISSLQPEDLATYYC (SEQ ID NO: 1702)
GVPSRFSGSGYGTDFFTISSLQPEDFATYFC (SEQ ID NO: 1703)
GVPSRFSGSGYGTDFTLTISSVQPEDLATYYC (SEQ ID NO: 1704)
GVPSRFSGSGYGTDFTLTISSVQPEDFATYFC (SEQ ID NO: 1705)
GVPSRFSGSGYGTDFTLTISSLQPEDLATYFC (SEQ ID NO: 1706)
GVPSRFSGSGSGTDFFTISSVQPEDLATYYC (SEQ ID NO: 1707)
GVPSRFSGSGSGTDFFTISSVQPEDFATYFC (SEQ ID NO: 1708)

TABLE 9-continued

Amino Acid Sequences derived from Murine 128A Antibody.

GVPSRFSGSGSGTDFTLTISS<u>V</u>QPED<u>L</u>ATY<u>F</u>C (SEQ ID NO: 1709)
GVPSRFSGSG<u>Y</u>GTDFT<u>F</u>TISS<u>V</u>QPED<u>L</u>ATYYC (SEQ ID NO: 1710)
GVPSRFSGSG<u>Y</u>GTDFT<u>F</u>TISS<u>V</u>QPEDFATY<u>F</u>C (SEQ ID NO: 1711)
GVPSRFSGSG<u>Y</u>GTDFTLTISS<u>V</u>QPED<u>L</u>ATY<u>F</u>C (SEQ ID NO: 1712)
GVPSRFSGSGSGTDFT<u>F</u>TISS<u>V</u>QPED<u>L</u>ATY<u>F</u>C (SEQ ID NO: 1713)
GVPSRFSGSG<u>Y</u>GTDFT<u>F</u>TISS<u>V</u>QPED<u>L</u>ATY<u>F</u>C (SEQ ID NO: 1714)

h128A VL CDR3
QQDYSSPRT (SEQ ID NO: 1493)

h128A VL FR4
FGQGTKLEIK (SEQ ID NO: 78)

TABLE 10

Amino Acid Sequences derived from Murine 124A Antibody.

124A HUMANIZED ANTIBODY SEQUENCE: HEAVY CHAIN
h124AH1 Variable Region
QVQLVQSGAEVKKPGASVKVSCKASGYTFSSNWIEWVRQAPGQGLEWMG**E
ILPGSGSTSYAQKFQGRVTMTRDTSTSTVYMELSSLRSEDTAVYYCARWL
LYYYAMDF**WGQGTLVTVSS (SEQ ID NO: 1541)

h124A VH FR1
QVQLVQSGAEVKKPGASVKVSCKAS (SEQ ID NO: 51)
QVQLVQSGAEV<u>M</u>KPGASVKVSCKAS (SEQ ID NO: 39)
QVQLVQSGAEVKKPGAS<u>I</u>KVSCKAS (SEQ ID NO: 1715)
QVQLVQSGAEV<u>M</u>KPGAS<u>I</u>KVSCKAS (SEQ ID NO: 1716)

h124A VH CDR1
GYTFSSNWIE (SEQ ID NO: 1316)
GYTFSS<u>Q</u>WIE (SEQ ID NO: 1717)
GYTFSS<u>S</u>WIE (SEQ ID NO: 1718)
GYTFSS<u>A</u>WIE (SEQ ID NO: 1719)
GYTFSS<u>D</u>WIE (SEQ ID NO: 1720)

h124A VH FR2
WVRQAPGQGLEWMG (SEQ ID NO: 52)

h124A VH CDR2
EILPGSGSTS (SEQ ID NO: 1098)

h124A VH FR3
YAQKFQGRVTMTRDTSTSTVYMELSSLRSEDTAVYYCAR (SEQ ID NO: 1560)
<u>YN</u>QKFQGRVTMTRDTSTSTVYMELSSLRSEDTAVYYCAR (SEQ ID NO: 1561)
YAQKFQGR<u>A</u>TMTRDTSTSTVYMELSSLRSEDTAVYYCAR (SEQ ID NO: 1562)
YAQKFQGRVT<u>F</u>TRDTSTSTVYMELSSLRSEDTAVYYCAR (SEQ ID NO: 1721)
YAQKFQGRVTMT<u>A</u>DTSTSTVYMELSSLRSEDTAVYYCAR (SEQ ID NO: 1722)
YAQKFQGRVTMTRDTSTST<u>A</u>YMELSSLRSEDTAVYYCAR (SEQ ID NO: 1566)
<u>YN</u>QKFQGR<u>A</u>TMTRDTSTSTVYMELSSLRSEDTAVYYCAR (SEQ ID NO: 1567)
<u>YN</u>QKFQGRVT<u>F</u>TRDTSTSTVYMELSSLRSEDTAVYYCAR (SEQ ID NO: 1723)
<u>YN</u>QKFQGRVTMT<u>A</u>DTSTSTVYMELSSLRSEDTAVYYCAR (SEQ ID NO: 1724)
<u>YN</u>QKFQGRVTMTRDTSTST<u>A</u>YMELSSLRSEDTAVYYCAR (SEQ ID NO: 1571)
YAQKFQGR<u>A</u>T<u>F</u>TRDTSTSTVYMELSSLRSEDTAVYYCAR (SEQ ID NO: 1725)
YAQKFQGR<u>A</u>TMT<u>A</u>DTSTSTVYMELSSLRSEDTAVYYCAR (SEQ ID NO: 1726)
YAQKFQGR<u>A</u>TMT<u>A</u>DTSTST<u>A</u>YMELSSLRSEDTAVYYCAR (SEQ ID NO: 1575)
YAQKFQGRVT<u>F</u>T<u>A</u>DTSTSTVYMELSSLRSEDTAVYYCAR (SEQ ID NO: 1727)
YAQKFQGRVT<u>F</u>TRDTSTST<u>A</u>YMELSSLRSEDTAVYYCAR (SEQ ID NO: 1728)

TABLE 10-continued

Amino Acid Sequences derived from Murine 124A Antibody.

YAQKFQGRVTMT<u>A</u>DTSTST<u>A</u>YMELSSLRSEDTAVYYCAR (SEQ ID NO: 1729)
<u>YN</u>QKFQGR<u>A</u>T<u>F</u>TRDTSTSTVYMELSSLRSEDTAVYYCAR (SEQ ID NO: 1730)
<u>YN</u>QKFQGR<u>A</u>TMT<u>A</u>DTSTSTVYMELSSLRSEDTAVYYCAR (SEQ ID NO: 1731)
<u>YN</u>QKFQGR<u>A</u>TMTRDTSTST<u>A</u>YMELSSLRSEDTAVYYCAR (SEQ ID NO: 1585)
<u>YN</u>QKFQGRVT<u>F</u>T<u>A</u>DTSTSTVYMELSSLRSEDTAVYYCAR (SEQ ID NO: 1732)
<u>YN</u>QKFQGRVT<u>F</u>TRDTSTST<u>A</u>YMELSSLRSEDTAVYYCAR (SEQ ID NO: 1733)
<u>YN</u>QKFQGRVTMT<u>A</u>DTSTST<u>A</u>YMELSSLRSEDTAVYYCAR (SEQ ID NO: 1734)
YAQKFQGR<u>A</u>T<u>F</u>T<u>A</u>DTSTSTVYMELSSLRSEDTAVYYCAR (SEQ ID NO: 1735)
YAQKFQGR<u>A</u>T<u>F</u>TRDTSTST<u>A</u>YMELSSLRSEDTAVYYCAR (SEQ ID NO: 1736)
YAQKFQGR<u>A</u>TMT<u>A</u>DTSTST<u>A</u>YMELSSLRSEDTAVYYCAR (SEQ ID NO: 1737)
YAQKFQGRVT<u>F</u>T<u>A</u>DTSTST<u>A</u>YMELSSLRSEDTAVYYCAR (SEQ ID NO: 1738)
<u>YN</u>QKFQGR<u>A</u>T<u>F</u>TRDTSTST<u>A</u>YMELSSLRSEDTAVYYCAR (SEQ ID NO: 1739)
<u>YN</u>QKFQGR<u>A</u>T<u>F</u>T<u>A</u>DTSTSTVYMELSSLRSEDTAVYYCAR (SEQ ID NO: 1740)
<u>YN</u>QKFQGR<u>A</u>TMT<u>A</u>DTSTST<u>A</u>YMELSSLRSEDTAVYYCAR (SEQ ID NO: 1741)
<u>YN</u>QKFQGR<u>A</u>T<u>F</u>TRDTSTST<u>A</u>YMELSSLRSEDTAVYYCAR (SEQ ID NO: 1742)

h124A VH CDR3
WLLYYYAMDF (SEQ ID NO: 1413)

h124A VH FR4
WGQGTLVTVSS (SEQ ID NO: 54)

124A HUMANIZED ANTIBODY SEQUENCE: LIGHT CHAIN
h124AL1 Variable Region
DVVMTQSPLSLPVTLGQPASISCRSSQSIVHNNGNTYLEWFQQRPGQSPR
RLIYKVSNRFSGVPDRFSGSGSGTDFTLKISRVEAEDVGVYYC**FQGSHVP
YT**FGQGTKLEIK (SEQ ID NO: 1546)

h124A VL FR1
DVVMTQSPLSLPVTLGQPASISC (SEQ ID NO: 1743)

h124A VL CDR1
RSSQSIVHNNGNTYLE (SEQ ID NO: 1462)
RSSQSIVH<u>Q</u>NGNTYLE (SEQ ID NO: 1744)
RSSQSIVH<u>S</u>NGNTYLE (SEQ ID NO: 45)
RSSQSIVH<u>A</u>NGNTYLE (SEQ ID NO: 1745)
RSSQSIVH<u>D</u>NGNTYLE (SEQ ID NO: 1746)
RSSQSIVHN<u>Q</u>GNTYLE (SEQ ID NO: 1747)
RSSQSIVHN<u>S</u>GNTYLE (SEQ ID NO: 1748)
RSSQSIVHN<u>A</u>GNTYLE (SEQ ID NO: 1749)
RSSQSIVHNNG<u>Q</u>TYLE (SEQ ID NO: 1750)
RSSQSIVHNNG<u>S</u>TYLE (SEQ ID NO: 1751)
RSSQSIVHNNG<u>A</u>TYLE (SEQ ID NO: 1752)
RSSQSIVHNNG<u>D</u>TYLE (SEQ ID NO: 1753)
RSSQSIVH<u>QQ</u>GNTYLE (SEQ ID NO: 1754)
RSSQSIVH<u>QS</u>GNTYLE (SEQ ID NO: 1755)
RSSQSIVH<u>QA</u>GNTYLE (SEQ ID NO: 1756)
RSSQSIVH<u>Q</u>NG<u>Q</u>TYLE (SEQ ID NO: 1757)
RSSQSIVH<u>Q</u>NG<u>S</u>TYLE (SEQ ID NO: 1758)
RSSQSIVH<u>Q</u>NG<u>A</u>TYLE (SEQ ID NO: 1759)
RSSQSIVH<u>Q</u>NG<u>D</u>TYLE (SEQ ID NO: 1760)
RSSQSIVH<u>SQ</u>GNTYLE (SEQ ID NO: 253)
RSSQSIVH<u>SS</u>GNTYLE (SEQ ID NO: 254)
RSSQSIVH<u>SA</u>GNTYLE (SEQ ID NO: 255)
RSSQSIVH<u>S</u>NG<u>Q</u>TYLE (SEQ ID NO: 256)
RSSQSIVH<u>S</u>NG<u>S</u>TYLE (SEQ ID NO: 257)
RSSQSIVH<u>S</u>NG<u>A</u>TYLE (SEQ ID NO: 258)
RSSQSIVH<u>S</u>NG<u>D</u>TYLE (SEQ ID NO: 259)
RSSQSIVH<u>AQ</u>GNTYLE (SEQ ID NO: 1761)
RSSQSIVH<u>AS</u>GNTYLE (SEQ ID NO: 1762)
RSSQSIVH<u>AA</u>GNTYLE (SEQ ID NO: 1763)
RSSQSIVH<u>A</u>NG<u>Q</u>TYLE (SEQ ID NO: 1764)

TABLE 10-continued

Amino Acid Sequences derived from Murine 124A Antibody.

```
RSSQSIVHANGSTYLE (SEQ ID NO: 1765)
RSSQSIVHANGATYLE (SEQ ID NO: 1766)
RSSQSIVHANGDTYLE (SEQ ID NO: 1767)
RSSQSIVHDQGNTYLE (SEQ ID NO: 1768)
RSSQSIVHDSGNTYLE (SEQ ID NO: 1769)
RSSQSIVHDAGNTYLE (SEQ ID NO: 1770)
RSSQSIVHDNGQTYLE (SEQ ID NO: 1771)
RSSQSIVHDNGSTYLE (SEQ ID NO: 1772)
RSSQSIVHDNGATYLE (SEQ ID NO: 1773)
RSSQSIVHDNGDTYLE (SEQ ID NO: 1774)
RSSQSIVHNQGQTYLE (SEQ ID NO: 1775)
RSSQSIVHNQGSTYLE (SEQ ID NO: 1776)
RSSQSIVHNQGATYLE (SEQ ID NO: 1777)
RSSQSIVHNQGDTYLE (SEQ ID NO: 1778)
RSSQSIVHNSGQTYLE (SEQ ID NO: 1779)
RSSQSIVHNSGSTYLE (SEQ ID NO: 1780)
RSSQSIVHNSGATYLE (SEQ ID NO: 1781)
RSSQSIVHNSGDTYLE (SEQ ID NO: 1782)
RSSQSIVHNAGQTYLE (SEQ ID NO: 1783)
RSSQSIVHNAGSTYLE (SEQ ID NO: 1784)
RSSQSIVHNAGATYLE (SEQ ID NO: 1785)
RSSQSIVHNAGDTYLE (SEQ ID NO: 1786)
RSSQSIVHQQGQTYLE (SEQ ID NO: 1787)
RSSQSIVHSQGQTYLE (SEQ ID NO: 260)
RSSQSIVHAQGQTYLE (SEQ ID NO: 1788)
RSSQSIVHDQGQTYLE (SEQ ID NO: 1789)
RSSQSIVHQSGQTYLE (SEQ ID NO: 1790)
RSSQSIVHQAGQTYLE (SEQ ID NO: 1791)
RSSQSIVHSSGQTYLE (SEQ ID NO: 264)
RSSQSIVHSAGQTYLE (SEQ ID NO: 268)
RSSQSIVHASGQTYLE (SEQ ID NO: 1792)
RSSQSIVHAAGQTYLE (SEQ ID NO: 1793)
RSSQSIVHDSGQTYLE (SEQ ID NO: 1794)
RSSQSIVHDAGQTYLE (SEQ ID NO: 1795)
RSSQSIVHQQGSTYLE (SEQ ID NO: 1796)
RSSQSIVHSQGSTYLE (SEQ ID NO: 261)
RSSQSIVHAQGSTYLE (SEQ ID NO: 1797)
RSSQSIVHDQGSTYLE (SEQ ID NO: 1798)
RSSQSIVHQSGSTYLE (SEQ ID NO: 1799)
RSSQSIVHQAGSTYLE (SEQ ID NO: 1800)
RSSQSIVHSSGSTYLE (SEQ ID NO: 265)
RSSQSIVHSAGSTYLE (SEQ ID NO: 269)
RSSQSIVHASGSTYLE (SEQ ID NO: 1801)
RSSQSIVHAAGSTYLE (SEQ ID NO: 1802)
RSSQSIVHDSGSTYLE (SEQ ID NO: 1803)
RSSQSIVHDAGSTYLE (SEQ ID NO: 1804)
RSSQSIVHQQGATYLE (SEQ ID NO: 1805)
RSSQSIVHSQGATYLE (SEQ ID NO: 262)
RSSQSIVHAQGATYLE (SEQ ID NO: 1806)
RSSQSIVHDQGATYLE (SEQ ID NO: 1807)
RSSQSIVHQSGATYLE (SEQ ID NO: 1808)
RSSQSIVHQAGATYLE (SEQ ID NO: 1809)
RSSQSIVHSSGATYLE (SEQ ID NO: 266)
RSSQSIVHSAGATYLE (SEQ ID NO: 270)
RSSQSIVHASGATYLE (SEQ ID NO: 1810)
RSSQSIVHAAGATYLE (SEQ ID NO: 1811)
RSSQSIVHDSGATYLE (SEQ ID NO: 1812)
RSSQSIVHDAGATYLE (SEQ ID NO: 1813)
RSSQSIVHQQGDTYLE (SEQ ID NO: 1814)
RSSQSIVHSQGDTYLE (SEQ ID NO: 263)
RSSQSIVHAQGDTYLE (SEQ ID NO: 1815)
RSSQSIVHDQGDTYLE (SEQ ID NO: 1816)
RSSQSIVHQSGDTYLE (SEQ ID NO: 1817)
RSSQSIVHQAGDTYLE (SEQ ID NO: 1818)
RSSQSIVHSSGDTYLE (SEQ ID NO: 267)
RSSQSIVHSAGDTYLE (SEQ ID NO: 271)
RSSQSIVHASGDTYLE (SEQ ID NO: 1819)
RSSQSIVHAAGDTYLE (SEQ ID NO: 1820)
RSSQSIVHDSGDTYLE (SEQ ID NO: 1821)
RSSQSIVHDAGDTYLE (SEQ ID NO: 1822)

h124A VL FR2
WFQQRPGQSPRRLIY (SEQ ID NO: 1823)
WYQQRPGQSPRRLIY (SEQ ID NO: 1824)
WFQQRPGQSPRLLIY (SEQ ID NO: 1825)
WYQQRPGQSPRLLIY (SEQ ID NO: 1826)

h124A VL CDR2
KVSNRFS (SEQ ID NO: 40)
KVSQRFS (SEQ ID NO: 843)
KVSSRFS (SEQ ID NO: 844)
KVSARFS (SEQ ID NO: 846)
KVSDRFS (SEQ ID NO: 845)

h124A VL FR3
GVPDRFSGSGSGTDFTLKISRVEAEDVGVYYC (SEQ ID NO: 77)
GVPDRFSGSGSGTDFTLKISRVEAEDLGVYYC (SEQ ID NO: 276)

h124A VL CDR3
FQGSHVPYT (SEQ ID NO: 1511)

h124A VL FR4
FGQGTKLEIK (SEQ ID NO: 78)
```

TABLE 11

Amino Acid Sequences derived from Murine 259A Antibody.

```
259A HUMANIZED ANTIBODY SEQUENCE: HEAVY CHAIN
h259AH1 Variable Region
QVQLVQSGAEVKKPGASVKVSCKASGYTFTSYFMHWVRQAPGQGLEWMGY
IYPYNDGTKYAQKFQGRVTMTRDTSTSTVYMELSSLRSEDTAVYYCARFD
YDTLRYWGQGTLVTVSS
(SEQ ID NO: 1543)

h259A VH FR1
QVQLVQSGAEVKKPGASVKVSCKAS (SEQ ID NO: 51)
QVQLVQSGAEVVKPGASVKVSCKAS (SEQ ID NO: 1550)
QVQLVQSGAEVKKPGASVKMSCKAS (SEQ ID NO: 1827)
QVQLVQSGAEVVKPGASVKMSCKAS (SEQ ID NO: 1828)

h259A VH CDR1
GYTFTSYFMH (SEQ ID NO: 1306)

h259A VH FR2
WVRQAPGQGLEWMG (SEQ ID NO: 52)
WVRQAPGQGLEWIG (SEQ ID NO: 106)

h259A VH CDR2
YIYPYNDGTK (SEQ ID NO: 1372)
```

TABLE 11-continued

Amino Acid Sequences derived from Murine 259A Antibody.

YIYPYQDGTK (SEQ ID NO: 1829)
YIYPYSDGTK (SEQ ID NO: 1830)
YIYPYADGTK (SEQ ID NO: 1831)
YIYPYDDGTK (SEQ ID NO: 1832)
YIYPYNEGTK (SEQ ID NO: 1833)
YIYPYNSGTK (SEQ ID NO: 1834)
YIYPYNAGTK (SEQ ID NO: 1835)
YIYPYQEGTK (SEQ ID NO: 1836)
YIYPYQSGTK (SEQ ID NO: 1837)
YIYPYQAGTK (SEQ ID NO: 1838)
YIYPYSEGTK (SEQ ID NO: 1839)
YIYPYSSGTK (SEQ ID NO: 1840)
YIYPYSAGTK (SEQ ID NO: 1841)
YIYPYAEGTK (SEQ ID NO: 1842)
YIYPYASGTK (SEQ ID NO: 1843)
YIYPYAAGTK (SEQ ID NO: 1844)
YIYPYDEGTK (SEQ ID NO: 1845)
YIYPYDSGTK (SEQ ID NO: 1846)
YIYPYDAGTK (SEQ ID NO: 1847)

h259A VH FR3
YAQKFQGRVTMTRDTSTSTVYMELSSLRSEDTAVYYCAR (SEQ ID NO: 1560)
YNQKFQGRVTMTRDTSTSTVYMELSSLRSEDTAVYYCAR (SEQ ID NO: 1561)
YAQKFQGRATMTRDTSTSTVYMELSSLRSEDTAVYYCAR (SEQ ID NO: 1562)
YAQKFQGRVTLTRDTSTSTVYMELSSLRSEDTAVYYCAR (SEQ ID NO: 1563)
YAQKFQGRVTMTFDTSTSTVYMELSSLRSEDTAVYYCAR (SEQ ID NO: 1848)
YAQKFQGRVTMTRDKSTSTVYMELSSLRSEDTAVYYCAR (SEQ ID NO: 1565)
YAQKFQGRVTMTRDTSTSTAYMELSSLRSEDTAVYYCAR (SEQ ID NO: 1566)
YNQKFQGRATMTRDTSTSTVYMELSSLRSEDTAVYYCAR (SEQ ID NO: 1567)
YNQKFQGRVTLTRDTSTSTVYMELSSLRSEDTAVYYCAR (SEQ ID NO: 1568)
YNQKFQGRVTMTFDTSTSTVYMELSSLRSEDTAVYYCAR (SEQ ID NO: 1849)
YNQKFQGRVTMTRDKSTSTVYMELSSLRSEDTAVYYCAR (SEQ ID NO: 1570)
YNQKFQGRVTMTRDTSTSTAYMELSSLRSEDTAVYYCAR (SEQ ID NO: 1571)
YAQKFQGRATLTRDTSTSTVYMELSSLRSEDTAVYYCAR (SEQ ID NO: 1572)
YAQKFQGRATMTFDTSTSTVYMELSSLRSEDTAVYYCAR (SEQ ID NO: 1850)
YAQKFQGRATMTRDKSTSTVYMELSSLRSEDTAVYYCAR (SEQ ID NO: 1574)
YAQKFQGRATMTRDTSTSTAYMELSSLRSEDTAVYYCAR (SEQ ID NO: 1575)
YAQKFQGRVTLTFDTSTSTVYMELSSLRSEDTAVYYCAR (SEQ ID NO: 1851)
YAQKFQGRVTLTRDKSTSTVYMELSSLRSEDTAVYYCAR (SEQ ID NO: 1577)
YAQKFQGRVTLTRDTSTSTAYMELSSLRSEDTAVYYCAR (SEQ ID NO: 1578)
YAQKFQGRVTMTFDKSTSTVYMELSSLRSEDTAVYYCAR (SEQ ID NO: 1852)
YAQKFQGRVTMTFDTSTSTAYMELSSLRSEDTAVYYCAR (SEQ ID NO: 1853)
YAQKFQGRVTMTRDKSTSTAYMELSSLRSEDTAVYYCAR (SEQ ID NO: 1581)
YNQKFQGRATLTRDTSTSTVYMELSSLRSEDTAVYYCAR (SEQ ID NO: 1582)
YNQKFQGRATMTFDTSTSTVYMELSSLRSEDTAVYYCAR (SEQ ID NO: 1854)
YNQKFQGRATMTRDKSTSTVYMELSSLRSEDTAVYYCAR (SEQ ID NO: 1584)
YNQKFQGRATMTRDTSTSTAYMELSSLRSEDTAVYYCAR (SEQ ID NO: 1585)
YNQKFQGRVTLTFDTSTSTVYMELSSLRSEDTAVYYCAR (SEQ ID NO: 1855)
YNQKFQGRVTLTRDKSTSTVYMELSSLRSEDTAVYYCAR (SEQ ID NO: 1587)

TABLE 11-continued

Amino Acid Sequences derived from Murine 259A Antibody.

YNQKFQGRVTLTRDTSTSTAYMELSSLRSEDTAVYYCAR (SEQ ID NO: 1588)
YNQKFQGRVTMTFDKSTSTVYMELSSLRSEDTAVYYCAR (SEQ ID NO: 1856)
YNQKFQGRVTMTFDTSTSTAYMELSSLRSEDTAVYYCAR (SEQ ID NO: 1857)
YNQKFQGRVTMTRDKSTSTAYMELSSLRSEDTAVYYCAR (SEQ ID NO: 1591)
YAQKFQGRATLTFDTSTSTVYMELSSLRSEDTAVYYCAR (SEQ ID NO: 1858)
YAQKFQGRATLTRDKSTSTVYMELSSLRSEDTAVYYCAR (SEQ ID NO: 1593)
YAQKFQGRATLTRDTSTSTAYMELSSLRSEDTAVYYCAR (SEQ ID NO: 1594)
YAQKFQGRATMTFDKSTSTVYMELSSLRSEDTAVYYCAR (SEQ ID NO: 1859)
YAQKFQGRATMTFDTSTSTAYMELSSLRSEDTAVYYCAR (SEQ ID NO: 1860)
YAQKFQGRATMTRDKSTSTAYMELSSLRSEDTAVYYCAR (SEQ ID NO: 1597)
YAQKFQGRVTLTFDKSTSTVYMELSSLRSEDTAVYYCAR (SEQ ID NO: 1861)
YAQKFQGRVTLTFDTSTSTAYMELSSLRSEDTAVYYCAR (SEQ ID NO: 1862)
YAQKFQGRVTMTFDKSTSTVYMELSSLRSEDTAVYYCAR (SEQ ID NO: 1863)
YNQKFQGRATLTFDTSTSTVYMELSSLRSEDTAVYYCAR (SEQ ID NO: 1864)
YNQKFQGRATLTRDKSTSTVYMELSSLRSEDTAVYYCAR (SEQ ID NO: 1602)
YNQKFQGRATLTRDTSTSTAYMELSSLRSEDTAVYYCAR (SEQ ID NO: 1603)
YNQKFQGRVTLTFDKSTSTVYMELSSLRSEDTAVYYCAR (SEQ ID NO: 1865)
YNQKFQGRVTLTFDTSTSTAYMELSSLRSEDTAVYYCAR (SEQ ID NO: 1866)
YNQKFQGRVTMTFDKSTSTAYMELSSLRSEDTAVYYCAR (SEQ ID NO: 1867)
YAQKFQGRATLTFDKSTSTVYMELSSLRSEDTAVYYCAR (SEQ ID NO: 1868)
YAQKFQGRATLTFDTSTSTAYMELSSLRSEDTAVYYCAR (SEQ ID NO: 1869)
YAQKFQGRATMTFDKSTSTAYMELSSLRSEDTAVYYCAR (SEQ ID NO: 1870)
YAQKFQGRVTLTFDKSTSTAYMELSSLRSEDTAVYYCAR (SEQ ID NO: 1871)
YNQKFQGRATLTFDKSTSTVYMELSSLRSEDTAVYYCAR (SEQ ID NO: 1872)
YNQKFQGRATLTFDTSTSTAYMELSSLRSEDTAVYYCAR (SEQ ID NO: 1873)
YAQKFQGRATLTFDKSTSTAYMELSSLRSEDTAVYYCAR (SEQ ID NO: 1874)
YNQKFQGRATLTFDKSTSTAYMELSSLRSEDTAVYYCAR (SEQ ID NO: 1875)

h259A VH CDR3
FDYDTLRY (SEQ ID NO: 1405)

h259A VH FR4
WGQGTLVTVSS (SEQ ID NO: 54)
WGQGTLLTVSS (SEQ ID NO: 320)

259A HUMANIZED ANTIBODY SEQUENCE: LIGHT CHAIN
h259AL1 Variable Region
DIVMTQSPLSLPVTPGEPASISCKSTKSLLNSDGFTYLDWYLQKPGQSPQ
LLIYLISNRFSGVPDRFSGSGSGTDFTLKISRVEAEDVGVYYC**FQSNYFP
WT**FGQGTKLEIK (SEQ ID NO: 1548)

h259A VL FR1
DIVMTQSPLSLPVTPGEPASISC (SEQ ID NO: 75)
DVVMTQSPLSLPVTPGEPASISC (SEQ ID NO: 252)
DIVLTQSPLSLPVTPGEPASISC (SEQ ID NO: 1876)
DVVLTQSPLSLPVTPGEPASISC (SEQ ID NO: 1877)

h259A VL CDR1
KSTKSLLNSDGFTYLD (SEQ ID NO: 1458)
KSTKSLLQSDGFTYLD (SEQ ID NO: 1878)

TABLE 11-continued

Amino Acid Sequences derived from Murine 259A Antibody.

```
KSTKSLLSSDGFTYLD  (SEQ ID NO: 1879)
KSTKSLLASDGFTYLD  (SEQ ID NO: 1880)
KSTKSLLDSDGFTYLD  (SEQ ID NO: 1881)
KSTKSLLNSEGFTYLD  (SEQ ID NO: 1882)
KSTKSLLNSSGFTYLD  (SEQ ID NO: 1883)
KSTKSLLNSAGFTYLD  (SEQ ID NO: 1884)
KSTKSLLQSEGFTYLD  (SEQ ID NO: 1885)
KSTKSLLQSSGFTYLD  (SEQ ID NO: 1886)
KSTKSLLQSAGFTYLD  (SEQ ID NO: 1887)
KSTKSLLSSEGFTYLD  (SEQ ID NO: 1888)
KSTKSLLSSSGFTYLD  (SEQ ID NO: 1889)
KSTKSLLSSAGFTYLD  (SEQ ID NO: 1890)
KSTKSLLASEGFTYLD  (SEQ ID NO: 1891)
KSTKSLLASSGFTYLD  (SEQ ID NO: 1892)
KSTKSLLASAGFTYLD  (SEQ ID NO: 1893)
KSTKSLLDSEGFTYLD  (SEQ ID NO: 1894)
KSTKSLLDSSGFTYLD  (SEQ ID NO: 1895)
KSTKSLLDSAGFTYLD  (SEQ ID NO: 1896)

h259A VL FR2
WYLQKPGQSPQLLIY (SEQ ID NO: 76)

h259A VL CDR2
LISNRFS (SEQ ID NO: 1485)
LISQRFS (SEQ ID NO: 1897)
LISSRFS (SEQ ID NO: 1898)
LISARFS (SEQ ID NO: 1899)
LISDRFS (SEQ ID NO: 1900)

h259A VL FR3
GVPDRFSGSGSGTDFTLKISRVEAEDVGVYYC (SEQ ID NO: 77)
GVPDRFSGSGSGTDFTLKISRVEAEDVGLYYC (SEQ ID NO: 1901)

h259A VL CDR3
FQSNYFPWT (SEQ ID NO: 1508)

h259A VL FR4
FGQGTKLEIK (SEQ ID NO: 78)
```

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:36; (2) a VH CDR2 having an amino acid sequence of SEQ ID NO:37; and (3) a VH CDR3 having an amino acid sequence of SEQ ID NO:38. In certain embodiments, the antibody further comprises a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47. In other embodiments, the antibody further comprises a VL region having the amino acid sequence of SEQ ID NO:6. In another embodiment, the antibody further comprises a VL region having the amino acid sequence of SEQ ID NO:28. In yet other embodiments, the antibody further comprises a VL region having the amino acid sequence of SEQ ID NO:29. In some embodiments, the antibody comprises (a) a VH region comprising: (1) a VH CDR1 having an amino acid sequence of SEQ ID NO:36; (2) a VH CDR2 having an amino acid sequence of SEQ ID NO:37; and (3) a VH CDR3 having an amino acid sequence of SEQ ID NO:38; and (b) a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47. To the extent an antibody provided herein is the to "bind to a C10orf54 epitope", it is envisioned those antibodies also bind to a C10orf54 polypeptide, polypeptide fragment, or antigen thereof.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:36; (2) a VH CDR2 having an amino acid sequence of SEQ ID NO:50; and (3) a VH CDR3 having an amino acid sequence of SEQ ID NO:38. In certain embodiments, the antibody further comprises a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47. In other embodiments, the antibody further comprises a VL region having the amino acid sequence of SEQ ID NO:6. In another embodiment, the antibody further comprises a VL region having the amino acid sequence of SEQ ID NO:28. In yet other embodiments, the antibody further comprises a VL region having the amino acid sequence of SEQ ID NO:29. In some embodiments, the antibody comprises: (a) a VH region comprising: (1) a VH CDR1 having an amino acid sequence of SEQ ID NO:36; (2) a VH CDR2 having an amino acid sequence of SEQ ID NO:50; and (3) a VH CDR3 having an amino acid sequence of SEQ ID NO:38; and (b) a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:36; (2) a VH CDR2 having an amino acid sequence of SEQ ID NO:99; and (3) a VH CDR3 having an amino acid sequence of SEQ ID NO:38. In certain embodiments, the antibody further comprises a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47. In other embodiments, the antibody further comprises a VL region having the amino acid sequence of SEQ ID NO:6. In another embodiment, the antibody further comprises a VL region having the amino acid sequence of SEQ ID NO:28. In yet other embodiments, the antibody further comprises a VL region having the amino acid sequence of SEQ ID NO:29. In some embodiments, the antibody comprises: (a) a VH region comprising: (1) a VH CDR1 having an amino acid sequence of SEQ ID NO:36; (2) a VH CDR2 having an amino acid sequence of SEQ ID NO:99; and (3) a VH CDR3 having an amino acid sequence of SEQ ID NO:38; and (b) a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47.

In another embodiment, an antibody that binds to C10orf54 (e.g., C10orf54 polypeptide, C10orf54 polypeptide fragment, C10orf54 epitope) comprises: a VL region comprising: (1) a VL CDR1 having an amino acid sequence of SEQ ID NO:45; (2) a VL CDR2 having an amino acid sequence of SEQ ID NO:46; and (3) a VL CDR3 having an amino acid sequence of SEQ ID NO:47. In some embodiments, the antibody further comprises a VH region having the amino acid sequence of SEQ ID NO:20. In another embodiment, the antibody further comprises a VH region having the amino acid sequence of SEQ ID NO:21. In other embodiments, the antibody further comprises a VH region having the amino acid sequence of SEQ ID NO:22. In other embodiments, the antibody further comprises a VH region having the amino acid sequence of SEQ ID NO:23.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:30; (2) a VH CDR2 having an amino acid sequence of SEQ ID NO:31; and (3) a VH CDR3 having an amino acid sequence of SEQ ID NO:32. In some embodiments, the antibody further comprises a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41. In other embodiments, the antibody further comprises a VL region having the amino acid sequence of SEQ ID NO:24. In another embodiment, the antibody further comprises a VL region having the amino acid sequence of SEQ ID NO:25. In one embodiment, the antibody comprises: (a) a VH region comprising: (1) a VH CDR1 having an amino acid sequence of SEQ ID NO:30; (2) a VH CDR2 having an amino acid sequence of SEQ ID NO:31; and (3) a VH CDR3 having an amino acid sequence of SEQ ID NO:32; and (b) a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:30; (2) a VH CDR2 having an amino acid sequence of SEQ ID NO:321; and (3) a VH CDR3 having an amino acid sequence of SEQ ID NO:32. In some embodiments, the antibody further comprises a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41. In other embodiments, the antibody further comprises a VL region having the amino acid sequence of SEQ ID NO:24. In another embodiment, the antibody further comprises a VL region having the amino acid sequence of SEQ ID NO:25. In one embodiment, the antibody comprises: (a) a VH region comprising: (1) a VH CDR1 having an amino acid sequence of SEQ ID NO:30; (2) a VH CDR2 having an amino acid sequence of SEQ ID NO:321; and (3) a VH CDR3 having an amino acid sequence of SEQ ID NO:32; and (b) a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:30; (2) a VH CDR2 having an amino acid sequence of SEQ ID NO:835; and (3) a VH CDR3 having an amino acid sequence of SEQ ID NO:32. In some embodiments, the antibody further comprises a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41. In other embodiments, the antibody further comprises a VL region having the amino acid sequence of SEQ ID NO:24. In another embodiment, the antibody further comprises a VL region having the amino acid sequence of SEQ ID NO:25. In one embodiment, the antibody comprises: (a) a VH region comprising: (1) a VH CDR1 having an amino acid sequence of SEQ ID NO:30; (2) a VH CDR2 having an amino acid sequence of SEQ ID NO:835; and (3) a VH CDR3 having an amino acid sequence of SEQ ID NO:32; and (b) a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41.

In some embodiments, an antibody that binds to C10orf54 (e.g., C10orf54 polypeptide, C10orf54 polypeptide fragment, C10orf54 epitope) comprises: a VL region comprising: (1) a VL CDR1 having an amino acid sequence of SEQ ID NO:45; (2) a VL CDR2 having an amino acid sequence of SEQ ID NO:40; and (3) a VL CDR3 having an amino acid sequence of SEQ ID NO:41. In some embodiments, the antibody further comprises a VH region having the amino acid sequence of SEQ ID NO:12. In another embodiment, the antibody further comprises a VH region having the amino acid sequence of SEQ ID NO:13. In other embodiments, the antibody further comprises a VH region having the amino acid sequence of SEQ ID NO:14. In other embodiments, the antibody further comprises a VH region having the amino acid sequence of SEQ ID NO:15.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:33; (2) a VH CDR2 having an amino acid sequence of SEQ ID NO:34; and (3) a VH CDR3 having an amino acid sequence of SEQ ID NO:35. In some embodiments, the antibody further comprises a VL region comprising: (1) a VL CDR1 having an amino acid sequence of SEQ ID NO:42; (2) a VL CDR2 having an amino acid sequence of SEQ ID NO:43; and (3) a VL CDR3 having an amino acid sequence of SEQ ID NO:44. In other embodiments, the antibody further comprises a VL region having the amino acid sequence of SEQ ID NO:26. In another embodiment, the antibody further comprises a VL region having the amino acid sequence of SEQ ID NO:27. In one embodiment, the antibody comprises: (a) a VH region comprising: (1) a VH CDR1 having an amino acid sequence of SEQ ID NO:33; (2) a VH CDR2 having an amino acid sequence of SEQ ID NO:34; and (3) a VH CDR3 having an amino acid sequence of SEQ ID NO:35; and (b) a VL region comprising: (1) a VL CDR1 having an amino acid sequence of SEQ ID NO:42; (2) a VL CDR2 having an amino acid sequence of SEQ ID NO:43; and (3) a VL CDR3 having an amino acid sequence of SEQ ID NO:44.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:33; (2) a VH CDR2 having an amino acid sequence of SEQ ID NO:49; and (3) a VH CDR3 having an amino acid sequence of SEQ ID NO:35. In some embodiments, the antibody further comprises a VL region comprising: (1) a VL CDR1 having an amino acid sequence of SEQ ID NO:42; (2) a VL CDR2 having an amino acid sequence of SEQ ID NO:43; and (3) a VL CDR3 having an amino acid sequence of SEQ ID NO:44. In other embodiments, the antibody further comprises a VL region having the amino acid sequence of SEQ ID NO:26. In another embodiment, the antibody further comprises a VL region having the amino acid sequence of SEQ ID NO:27. In one embodiment, the antibody comprises: (a) a VH region comprising: (1) a VH CDR1 having an amino acid sequence of SEQ ID NO:33; (2) a VH CDR2 having an amino acid sequence of SEQ ID NO:49; and (3) a VH CDR3 having an amino acid sequence of SEQ ID NO:35; and (b) a VL region comprising: (1) a VL CDR1 having an amino acid sequence of SEQ ID NO:42; (2) a VL CDR2 having an amino acid sequence of SEQ ID NO:43; and (3) a VL CDR3 having an amino acid sequence of SEQ ID NO:44.

In one embodiment, an antibody that binds to C10orf54 (e.g., C10orf54 polypeptide, C10orf54 polypeptide fragment, C10orf54 epitope) comprises: (a) a VH region comprising: (1) a VH CDR1 having an amino acid sequence of SEQ ID NO:33; (2) a VH CDR2 having an amino acid sequence of SEQ ID NO:1070; and (3) a VH CDR3 having an amino acid sequence of SEQ ID NO:35. In some embodiments, the antibody further comprises a VL region comprising: (1) a VL CDR1 having an amino acid sequence of SEQ ID NO:42; (2) a VL CDR2 having an amino acid sequence of SEQ ID NO:43; and (3) a VL CDR3 having an amino acid sequence of SEQ ID NO:44. In other embodiments, the antibody further comprises a VL region having the amino acid sequence of SEQ ID NO:26. In another embodiment, the antibody further comprises a VL region having the amino acid sequence of SEQ ID NO:27. In one embodiment, the antibody comprises: (a) a VH region comprising: (1) a VH CDR1 having an amino acid sequence of SEQ ID NO:33; (2) a VH CDR2 having an amino acid sequence of SEQ ID NO:1070; and (3) a VH CDR3 having an amino acid sequence of SEQ ID NO:35; and (b) a VL region comprising: (1) a VL CDR1 having an amino acid sequence of SEQ ID NO:42; (2) a VL CDR2 having an amino acid sequence of SEQ ID NO:43; and (3) a VL CDR3 having an amino acid sequence of SEQ ID NO:44.

As will be understood by a person skilled in the art, the boundaries between the CDRs and framework sequences for any of the VH regions and VL regions described herein can be determined using any one of the well-known methods in the art, including IMGT, Kabat, Chothia, Contact, AbM or Kabat plus Chothia (e.g., "Exemplary" as described herein). Accordingly, any anti-C10orf54 antibody having one or more CDR or framework sequence as described herein includes a CDR or framework amino acid sequence as determined using IMGT, Kabat, Chothia, Contact, AbM or Kabat plus Chothis. For instance, exemplary CDR sequences for both VH and VL regions that can be included in an anti-C10orf54 antibody of the disclosure are depicted in Tables 12-33 (see also, e.g., Tables 5-11).

TABLE 12

Antibody 5B-CDR Sequences

| | | Exemplary* | IMGT | Kabat | Chothia | Contact | AbM |
|---|---|---|---|---|---|---|---|
| VH CDR Seq. | VH CDR1 | GYTFTDYGMH (SEQ ID NO: 1291) | GYTFTDYG (SEQ ID NO: 1292) | DYGMH (SEQ ID NO: 1293) | GYTFTDY (SEQ ID NO: 1294) | TDYGMH (SEQ ID NO: 1295) | GYTFTDYGMH (SEQ ID NO: 1291) |
| | VH CDR2 | IIDTYYGDATYNQKFKG (SEQ ID NO: 1336) | IDTYYGDA (SEQ ID NO: 1337) | IIDTYYGDATYNQKFKG (SEQ ID NO: 1336) | TYYG | WIGIIDTYYGDAT (SEQ ID NO: 1338) | IIDTYYGDAT (SEQ ID NO: 1339) | IIDTYYGDAT (SEQ ID NO: 1340) |
| | VH CDR3 | RAGNAMDY (SEQ ID NO: 1385) | ARRAGNAMDY (SEQ ID NO: 1386) | RAGNAMDY (SEQ ID NO: 1385) | AGNAMD (SEQ ID NO: 1387) | ARRAGNAMD (SEQ ID NO: 1388) | RAGNAMDY (SEQ ID NO: 1385) |
| VL CDR Seq. | VL CDR1 | KASQSVSNDVA (SEQ ID NO: 1425) | QSVSND (SEQ ID NO: 1426) | KASQSVSNDVA (SEQ ID NO: 1425) | SQSVSND (SEQ ID NO: 1427) | SNDVAWY (SEQ ID NO: 1428) | KASQSVSNDVA (SEQ ID NO: 1425) |
| | VL CDR2 | YASNRYT (SEQ ID NO: 1473) | YAS (SEQ ID NO: 1474) | YASNRYT (SEQ ID NO: 1473) | YAS (SEQ ID NO: 1474) | LLIYYASNRY (SEQ ID NO: 1475) | YASNRYT (SEQ ID NO: 1473) |

TABLE 12-continued

Antibody 5B-CDR Sequences

| | | | | | | |
|---|---|---|---|---|---|---|
| VL CDR3 | QQDYSSPRT (SEQ ID NO: 1493) | QQDYSSPRT (SEQ ID NO: 1493) | QQDYSSPRT (SEQ ID NO: 1493) | DYSSPR (SEQ ID NO: 1494) | QQDYSSPR (SEQ ID NO: 1495) | QQDYSSPRT (SEQ ID NO: 1493) |

VH Sequence:
QVQLQQSGAELVRPGVSVKISCKGSGYTFTDYGMHWVKQSHAKSLEWIGIIDTYYGDATYNQKFKGKATMTVDKSSTAY
MELARLTSEDSAIYYCARRAGNAMDYWGQGTSVTVSS (SEQ ID NO: 1252)

VL Sequence:
NIVMTQTPKFLLVSAGDRVTITCKASQSVSNDVAWYQQKPGQSPKLLIYYASNRYTGVPDRFTGSGYGTDFTFTISTVQAEDL
AVYFCQQDYSSPRTFGGGTKLEIK (SEQ ID NO: 1253)

*Exemplary CDR sequences encompass amino acids as determined by Kabat plus Chothia.

TABLE 13

Antibody 46A CDR Sequences

| | | Exemplary* | IMGT | Kabat | Chothia | Contact | AbM |
|---|---|---|---|---|---|---|---|
| VH CDR Seq. | VH CDR1 | GYTFTDYGMH (SEQ ID NO: 1291) | GYTFTDYG (SEQ ID NO: 1292) | DYGMH (SEQ ID NO: 1293) | GYTFTDY (SEQ ID NO: 1294) | TDYGMH (SEQ ID NO: 1295) | GYTFTDYGMH (SEQ ID NO: 1291) |
| | VH CDR2 | IINTYYGDATYNQKFKG (SEQ ID NO: 1341) | INTYYGDA (SEQ ID NO: 1342) | IINTYYGDATYNQKFKG (SEQ ID NO: 1341) | TYYG (SEQ ID NO: 1338) | WIGIINTYYGDAT (SEQ ID NO: 1343) | IINTYYGDAT (SEQ ID NO: 1344) |
| | VH CDR3 | RAGTAMDY (SEQ ID NO: 1389) | ARRAGTAMDY (SEQ ID NO: 1390) | RAGTAMDY (SEQ ID NO: 1389) | AGTAMD (SEQ ID NO: 1391) | ARRAGTAMD (SEQ ID NO: 1392) | RAGTAMDY (SEQ ID NO: 1389) |
| VL CDR Seq. | VL CDR1 | KASQSVSNDVA (SEQ ID NO: 1425) | QSVSND (SEQ ID NO: 1426) | KASQSVSNDVA (SEQ ID NO: 1425) | SQSVSND (SEQ ID NO: 1427) | SNDVAWY (SEQ ID NO: 1428) | KASQSVSNDVA (SEQ ID NO: 1425) |
| | VL CDR2 | YASNRYT (SEQ ID NO: 1473) | YAS (SEQ ID NO: 1474) | YASNRYT (SEQ ID NO: 1473) | YAS (SEQ ID NO: 1474) | LLIYYASNRY (SEQ ID NO: 1475) | YASNRYT (SEQ ID NO: 1473) |
| | VL CDR3 | QQDYGSPRT (SEQ ID NO: 1496) | QQDYGSPRT (SEQ ID NO: 1496) | QQDYGSPRT (SEQ ID NO: 1496) | DYGSPR (SEQ ID NO: 1497) | QQDYGSPR (SEQ ID NO: 1498) | QQDYGSPRT (SEQ ID NO: 1496) |

VH Sequence:
QVQLQQAGGELVRPGVSVKISCKGSGYTFTDYGMHWVKQSHAKSLEWIGIINTYYGDATYNQKFKGKATMTVDKSSTAYM
ELARLTSEDSAIYYCARRAGTAMDYWGQGTSVTVSS (SEQ ID NO: 1254)

VL Sequence:
SIVMTQTPKFLLVSAGDRVTITCKASQSVSNDVAWYQQKPGQSPKLLIYYASNRYTGVPDRFTGSGYGTDFTFTISTVQAEDLA
VYFCQQDYGSPRTFGGGTKLEIK (SEQ ID NO: 1255)

*Exemplary CDR sequences encompass amino acids as determined by Kabat plus Chothia.

TABLE 14

Antibody 97A CDR Sequences

| | | Exemplary* | IMGT | Kabat | Chothia | Contact | AbM |
|---|---|---|---|---|---|---|---|
| VH CDR Seq. | VH CDR1 | GYTFTDYGMH (SEQ ID NO: 1291) | GYTFTDYG (SEQ ID NO: 1292) | DYGMH (SEQ ID NO: 1293) | GYTFTDY (SEQ ID NO: 1294) | TDYGMH (SEQ ID NO: 1295) | GYTFTDYGMH (SEQ ID NO: 1291) |
| | VH CDR2 | VIDTYYGDASNNQKFKG (SEQ ID NO: 1345) | IDTYYGDA (SEQ ID NO: 1337) | VIDTYYGDASNNQKFKG (SEQ ID NO: 1345) | TYYG (SEQ ID NO: 1338) | WIGVIDTYYGDAS (SEQ ID NO: 1346) | VIDTYYGDAS (SEQ ID NO: 1347) |
| | VH CDR3 | RAGNAMDY (SEQ ID NO: 1385) | ARRAGNAMDY (SEQ ID NO: 1386) | RAGNAMDY (SEQ ID NO: 1385) | AGNAMD (SEQ ID NO: 1387) | ARRAGNAMD (SEQ ID NO: 1388) | RAGNAMDY (SEQ ID NO: 1385) |
| VL CDR Seq. | VL CDR1 | KASQSVSNDVA (SEQ ID NO: 1425) | QSVSND (SEQ ID NO: 1426) | KASQSVSNDVA (SEQ ID NO: 1425) | SQSVSND (SEQ ID NO: 1427) | SNDVAWY (SEQ ID NO: 1428) | KASQSVSNDVA (SEQ ID NO: 1425) |

TABLE 14-continued

Antibody 97A CDR Sequences

|  |  | Exemplary* | IMGT | Kabat | Chothia | Contact | AbM |
|---|---|---|---|---|---|---|---|
| | VL CDR2 | YASNRYT (SEQ ID NO: 1473) | YAS (SEQ ID NO: 1474) | YASNRYT (SEQ ID NO: 1473) | YAS (SEQ ID NO: 1474) | LLIYYASNRY (SEQ ID NO: 1475) | YASNRYT (SEQ ID NO: 1473) |
| | VL CDR3 | QQDYGSPRT (SEQ ID NO: 1496) | QQDYGSPRT (SEQ ID NO: 1496) | QQDYGSPRT (SEQ ID NO: 1496) | DYGSPR (SEQ ID NO: 1497) | QQDYGSPR (SEQ ID NO: 1498) | QQDYGSPRT (SEQ ID NO: 1496) |

VH Sequence:
QVQLQQSGAELVRPGVSVKISCKGSGYTFTDYGMHWVKQSHAKSLEWIGVIDTYYGDASNNQKFKGKATMTVDKSSSTAYM
ELARLTSEDSAIYYCARRAGNAMDYWGQGTSVTVSS (SEQ ID NO: 1256)

VL Sequence:
SIVMTQTPKFLLVSAGDRVAITCKASQSVSNDVAWYQQKPGQSPKLLIYYASNRYTGVPDRFTGSGYGTDFTFTISTVQAEDLAV
YFCQQDYGSPRTFGGGTKLEIK (SEQ ID NO: 1257)

*Exemplary CDR sequences encompass amino acids as determined by Kabat plus Chothia.

TABLE 15

Antibody 128A-CDR Sequences

|  |  | Exemplary* | IMGT | Kabat | Chothia | Contact | AbM |
|---|---|---|---|---|---|---|---|
| VH CDR Seq. | VH CDR1 | GYTFTDYGMH (SEQ ID NO: 1291) | GYTFTDYG (SEQ ID NO: 1292) | DYGMH (SEQ ID NO: 1293) | GYTFTDY (SEQ ID NO: 1294) | TDYGMH (SEQ ID NO: 1295) | GYTFTDYGMH (SEQ ID NO: 1291) |
| | VH CDR2 | LIDTYYGDATYN HKFKG (SEQ ID NO: 1348) | IDTYYGDA (SEQ ID NO: 1337) | LIDTYYGDATYN HKFKG (SEQ ID NO: 1348) | TYYG (SEQ ID NO: 1338) | WIGLIDTYYGDAT (SEQ ID NO: 1349) | LIDTYYGDAT (SEQ ID NO: 1350) |
| | VH CDR3 | RAGNAMDY (SEQ ID NO: 1385) | ARRAGNAMDY (SEQ ID NO: 1386) | RAGNAMDY (SEQ ID NO: 1385) | AGNAMD (SEQ ID NO: 1387) | ARRAGNAMD (SEQ ID NO: 1388) | RAGNAMDY (SEQ ID NO: 1385) |
| VL CDR Seq. | VL CDR1 | KASQSVSNDIA (SEQ ID NO: 1429) | QSVSND (SEQ ID NO: 1426) | KASQSVSNDIA (SEQ ID NO: 1429) | SQSVSND (SEQ ID NO: 1427) | SNDIAWY (SEQ ID NO: 1430) | KASQSVSNDIA (SEQ ID NO: 1429) |
| | VL CDR2 | YASNRYT (SEQ ID NO: 1473) | YAS (SEQ ID NO: 1474) | YASNRYT (SEQ ID NO: 1473) | YAS (SEQ ID NO: 1474) | LLIYYASNRY (SEQ ID NO: 1475) | YASNRYT (SEQ ID NO: 1473) |
| | VL CDR3 | QQDYSSPRT (SEQ ID NO: 1493) | QQDYSSPRT (SEQ ID NO: 1493) | QQDYSSPRT (SEQ ID NO: 1493) | DYSSPR (SEQ ID NO: 1494) | QQDYSSPR (SEQ ID NO: 1495) | QQDYSSPRT (SEQ ID NO: 1493) |

VH Sequence:
QVQLQQSGAELVRPGVSVKISCKGSGYTFTDYGMHWVKQSHAKSLEWIGLIDTYYGDATYNHKFKGKATMTVDKSSRTAYM
ELARLTSEDSAIYYCARRAGNAMDYWGQGTSVTASS (SEQ ID NO: 1258)

VL Sequence:
NIAMTQTPKFLLVSAGDRVTITCKASQSVSNDIAWYQQKPGQSPRLLIYYASNRYTGVPDRFTGSGYGTDFTFTISTVQAE
DLAVYFCQQDYSSPRTFGGGTKLEIK (SEQ ID NO: 1259)

*Exemplary CDR sequences encompass amino acids as determined by Kabat plus Chothia.

TABLE 16

Antibody 146C-CDR Sequences

|  |  | Exemplary* | IMGT | Kabat | Chothia | Contact | AbM |
|---|---|---|---|---|---|---|---|
| VH CDR Seq. | VH CDR1 | GYTFTDYGMH (SEQ ID NO: 1291) | GYTFTDYG (SEQ ID NO: 1292) | DYGMH (SEQ ID NO: 1293) | GYTFTDY (SEQ ID NO: 1294) | TDYGMH (SEQ ID NO: 1295) | GYTFTDYGMH (SEQ ID NO: 1291) |
| | VH CDR2 | LIDTYYGDATYN HKFKG (SEQ ID NO: 1348) | IDTYYGDA (SEQ ID NO: 1337) | LIDTYYGDATYN HKFKG (SEQ ID NO: 1348) | TYYG (SEQ ID NO: 1338) | WIGLIDTYYGDAT (SEQ ID NO: 1349) | LIDTYYGDAT (SEQ ID NO: 1350) |
| | VH CDR3 | RAGNAMDY (SEQ ID NO: 1385) | ARRAGNAMDY (SEQ ID NO: 1386) | RAGNAMDY (SEQ ID NO: 1385) | AGNAMD (SEQ ID NO: 1387) | ARRAGNAMD (SEQ ID NO: 1388) | RAGNAMDY (SEQ ID NO: 1385) |

TABLE 16-continued

Antibody 146C-CDR Sequences

| | | | | | | | |
|---|---|---|---|---|---|---|---|
| VL CDR Seq. | VL CDR1 | KASQSVSNDIA (SEQ ID NO: 1429) | QSVSND (SEQ ID NO: 1426) | KASQSVSNDIA (SEQ ID NO: 1429) | SQSVSND (SEQ ID NO: 1427) | SNDIAWY (SEQ ID NO: 1430) | KASQSVSNDIA (SEQ ID NO: 1429) |
| | VL CDR2 | YASNRYT (SEQ ID NO: 1473) | YAS (SEQ ID NO: 1474) | YASNRYT (SEQ ID NO: 1473) | YAS (SEQ ID NO: 1474) | LLIYYASNRY (SEQ ID NO: 1475) | YASNRYT (SEQ ID NO: 1473) |
| | VL CDR3 | QQDYSSPRT (SEQ ID NO: 1493) | QQDYSSPRT (SEQ ID NO: 1493) | QQDYSSPRT (SEQ ID NO: 1493) | DYSSPR (SEQ ID NO: 1494) | QQDYSSPR (SEQ ID NO: 1495) | QQDYSSPRT (SEQ ID NO: 1493) |

VH Sequence:
QVQLQQSGAELVRPGVSVKISCKGSGYTFTDYGMHWVKQSHAKSLEWIGLIDTYYGDATYNHKFKGKATMTVDKSSRTAY
MELARLTSEDSAIYYCARRAGNAMDYWGQGTSVTASS (SEQ ID NO: 1260)

VL Sequence:
NIAMTQTPKFLLVSAGDRVTITCKASQSVSNDIAWYQQKPGQSPRLLIYYASNRYTGVPDRFTGSGYGTDFTFTISTVQAED
LAVYFCQQDYSSPRTFGGGTKLEIK (SEQ ID NO: 1261)

*Exemplary CDR sequences encompass amino acids as determined by Kabat plus Chothia.

TABLE 17

Antibody 208A-CDR Sequences

| | | Exemplary* | IMGT | Kabat | Chothia | Contact | AbM |
|---|---|---|---|---|---|---|---|
| VH CDR Seq. | VH CDR1 | GYTFTDYGMH (SEQ ID NO: 1291) | GYTFTDYG (SEQ ID NO: 1292) | DYGMH (SEQ ID NO: 1293) | GYTFTDY (SEQ ID NO: 1294) | TDYGMH (SEQ ID NO: 1295) | GYTFTDYGMH (SEQ ID NO: 1291) |
| | VH CDR2 | VIDTYYGDAGYN QKFKG (SEQ ID NO: 1351) | IDTYYGDA (SEQ ID NO: 1337) | VIDTYYGDAGYN QKFKG (SEQ ID NO: 1351) | TYYG (SEQ ID NO: 1338) | WIGVIDTYYGDAG (SEQ ID NO: 1352) | VIDTYYGDAG (SEQ ID NO: 1353) |
| | VH CDR3 | RAGNAMDY (SEQ ID NO: 1385) | ARRAGNAMDY (SEQ ID NO: 1386) | RAGNAMDY (SEQ ID NO: 1385) | AGNAMD (SEQ ID NO: 1387) | ARRAGNAMD (SEQ ID NO: 1388) | RAGNAMDY (SEQ ID NO: 1385) |
| VL CDR Seq. | VL CDR1 | KASQSVSNDVA (SEQ ID NO: 1425) | QSVSND (SEQ ID NO: 1426) | KASQSVSNDVA (SEQ ID NO: 1425) | SQSVSND (SEQ ID NO: 1427) | SNDVAWY (SEQ ID NO: 1428) | KASQSVSNDVA (SEQ ID NO: 1425) |
| | VL CDR2 | YASNRYT (SEQ ID NO: 1473) | YAS (SEQ ID NO: 1474) | YASNRYT (SEQ ID NO: 1473) | YAS (SEQ ID NO: 1474) | LLIYYASNRY (SEQ ID NO: 1475) | YASNRYT (SEQ ID NO: 1473) |
| | VL CDR3 | QQDYSSPRT (SEQ ID NO: 1493) | QQDYSSPRT (SEQ ID NO: 1493) | QQDYSSPRT (SEQ ID NO: 1493) | DYSSPR (SEQ ID NO: 1494) | QQDYSSPR (SEQ ID NO: 1495) | QQDYSSPRT (SEQ ID NO: 1493) |

VH Sequence:
QVQLQQSGAELVRPGVSVKISCKGSGYTFTDYGMHWVKQSHAKSLEWIGVIDTYYGDAGYNQKFKGKATMTVDKSSTAYM
ELARLTSEDSAIYYCARRAGNAMDYWGQGTSVTVSS (SEQ ID NO: 1262)

VL Sequence:
SIVMTQTPKFLLVSAGDRVTITCKASQSVSNDVAWYQQKPGQSPKLLIYYASNRYTGVPDRFTGSGYGTDFTFTISTVQAEDL
AVYFCQQDYSSPRTFGGGTKLEIK (SEQ ID NO: 1263)

*Exemplary CDR sequences encompass amino acids as determined by Kabat plus Chothia.

TABLE 18

Antibody 215A-CDR Sequences

| | | Exemplary* | IMGT | Kabat | Chothia | Contact | AbM |
|---|---|---|---|---|---|---|---|
| VH CDR Seq. | VH CDR1 | GFSFTGYTMN (SEQ ID NO: 1296) | GFSFTGYT (SEQ ID NO: 1297) | GYTMN (SEQ ID NO: 1298) | GFSFTGY (SEQ ID NO: 1299) | TGYTMN (SEQ ID NO: 1300) | GFSFTGYTMN (SEQ ID NO: 1296) |
| | VH CDR2 | LISPYNGGTSYN QKFKG (SEQ ID NO: 1354) | ISPYNGGT (SEQ ID NO: 1355) | LISPYNGGTSYN QKFKG (SEQ ID NO: 1354) | PYNG (SEQ ID NO: 1356) | WIGLISPYNGGTS (SEQ ID NO: 1357) | LISPYNGGTS (SEQ ID NO: 1358) |

TABLE 18-continued

Antibody 215A-CDR Sequences

| | | | | | | | |
|---|---|---|---|---|---|---|---|
| | VH CDR3 | RAYGYAMDY (SEQ ID NO: 1393) | ARRAYGYAMDY (SEQ ID NO: 1394) | RAYGYAMDY (SEQ ID NO: 1393) | AYGYAMD (SEQ ID NO: 1395) | ARRAYGYAMD (SEQ ID NO: 1396) | RAYGYAMDY (SEQ ID NO: 1393) |
| VL CDR Seq. | VL CDR1 | SASSSVSYMF (SEQ ID NO: 1431) | SSVSY (SEQ ID NO: 1432) | SASSSVSYMF (SEQ ID NO: 1431) | SSSVSY (SEQ ID NO: 1433) | SYMFWY (SEQ ID NO: 1434) | SASSSVSYMF (SEQ ID NO: 1431) |
| | VL CDR2 | DTSNLAS (SEQ ID NO: 1476) | DTS (SEQ ID NO: 1477) | DTSNLAS (SEQ ID NO: 1476) | DTS (SEQ ID NO: 1477) | LLIYDTSNLA (SEQ ID NO: 1478) | DTSNLAS (SEQ ID NO: 1476) |
| | VL CDR3 | QQWSSYPFT (SEQ ID NO: 1499) | QQWSSYPFT (SEQ ID NO: 1499) | QQWSSYPFT (SEQ ID NO: 1499) | WSSYPF (SEQ ID NO: 1500) | QQWSSYPF (SEQ ID NO: 1501) | QQWSSYPFT (SEQ ID NO: 1499) |

VH Sequence:
EVQLQQSGPELVKPGASMKISCKASGFSFTGYTMNWVKQSHGKNLEWIGLISPYNGGTSYNQKFKGKATLTVDKSSSTA
YMELLSLTSEDSAVYYCARRAYGYAMDYWGQGTSVTVSS (SEQ ID NO: 1264)

VL Sequence:
QIVLTQSPAIMSASPGEKVTMTCSASSSVSYMFWYQQKPGSSPRLLIYDTSNLASGVPLRFSGSGSGTSYSLTISRMEAED
AATYYCQQWSSYPFTFGSGTKLEIK (SEQ ID NO: 1265)

*Exemplary CDR sequences encompass amino acids as determined by Kabat plus Chothia.

TABLE 19

Antibody 26A-CDR Sequences

| | | Exemplary* | IMGT | Kabat | Chothia | Contact | AbM |
|---|---|---|---|---|---|---|---|
| VH CDR Seq. | VH CDR1 | GFSFTGYTMN (SEQ ID NO: 1296) | GFSFTGYT (SEQ ID NO: 1297) | GYTMN (SEQ ID NO: 1298) | GFSFTGY (SEQ ID NO: 1299) | TGYTMN (SEQ ID NO: 1300) | GFSFTGYTMN (SEQ ID NO: 1296) |
| | VH CDR2 | LISPYNGGTSYN QKFKG (SEQ ID NO: 1354) | ISPYNGGT (SEQ ID NO: 1355) | LISPYNGGTSYN QKFKG (SEQ ID NO: 1354) | PYNG (SEQ ID NO: 1356) | WIGLISPYNGGTS (SEQ ID NO: 1357) | LISPYNGGTS (SEQ ID NO: 1358) |
| | VH CDR3 | RAYGYAMDY (SEQ ID NO: 1393) | ARRAYGYAMDY (SEQ ID NO: 1394) | RAYGYAMDY (SEQ ID NO: 1393) | AYGYAMD (SEQ ID NO: 1395) | ARRAYGYAMD (SEQ ID NO: 1396) | RAYGYAMDY (SEQ ID NO: 1393) |
| VL CDR Seq. | VL CDR1 | SASSSVSYMY (SEQ ID NO: 1435) | SSVSY (SEQ ID NO: 1432) | SASSSVSYMY (SEQ ID NO: 1435) | SSSVSY (SEQ ID NO: 1433) | SYMYWY (SEQ ID NO: 1436) | SASSSVSYMY (SEQ ID NO: 1435) |
| | VL CDR2 | DTSNLAS (SEQ ID NO: 1476) | DTS (SEQ ID NO: 1477) | DTSNLAS (SEQ ID NO: 1476) | DTS (SEQ ID NO: 1477) | LLIYDTSNLA (SEQ ID NO: 1478) | DTSNLAS (SEQ ID NO: 1476) |
| | VL CDR3 | QQWSSYPFT (SEQ ID NO: 1499) | QQWSSYPFT (SEQ ID NO: 1499) | QQWSSYPFT (SEQ ID NO: 1499) | WSSYPF (SEQ ID NO: 1500) | QQWSSYPF (SEQ ID NO: 1501) | QQWSSYPFT (SEQ ID NO: 1499) |

VH Sequence:
EVQLQQSGPELVKPGASMKISCKASGFSFTGYTMNWVKQSHVKNLEWIGLISPYNGGTSYNQKFKGKATLTVDKSSSTA
YMELLSLTSEDSAVYYCARRAYGYAMDYWGQGTSVTVSS (SEQ ID NO: 1266)

VL Sequence:
QIVLTQSPAIMSASPGEKVTMTCSASSSVSYMYWYQQKPGSSPRLLIYDTSNLASGVPLRFSGSGSGTSYSLTISRMEA
EDAATYYCQQWSSYPFTFGSGTKLEIK (SEQ ID NO: 1267)

*Exemplary CDR sequences encompass amino acids as determined by Kabat plus Chothia.

TABLE 20

Antibody 164A-CDR Sequences

| | | Exemplary* | IMGT | Kabat | Chothia | Contact | AbM |
|---|---|---|---|---|---|---|---|
| VH CDR Seq. | VH CDR1 | GYSFTGYNMN (SEQ ID NO: 30) | GYSFTGYN (SEQ ID NO: 1099) | GYNMN (SEQ ID NO: 1104) | GYSFTGY (SEQ ID NO: 1105) | TGYNMN (SEQ ID NO: 1110) | GYSFTGYNMN (SEQ ID NO: 30) |
| | VH | NIDPYYGSASYN | IDPYYGSA | NIDPYYGSASYN | PYYG | WIGNIDPYYGSAS | NIDPYYGSAS |

TABLE 20-continued

Antibody 164A-CDR Sequences

|  |  |  |  |  |  |  |  |
|---|---|---|---|---|---|---|---|
|  | CDR2 | QKFKG (SEQ ID NO: 1359) | (SEQ ID NO: 1360) | QKFKG (SEQ ID NO: 1359) | (SEQ ID NO: 1361) | (SEQ ID NO: 1362) | (SEQ ID NO: 1363) |
|  | VH CDR3 | SNYGYYGYFDV (SEQ ID NO: 1397) | TRSNYGYYGYFDV (SEQ ID NO: 1398) | SNYGYYGYFDV (SEQ ID NO: 1397) | NYGYYGYFD (SEQ ID NO: 1399) | TRSNYGYYGYFD (SEQ ID NO: 1400) | SNYGYYGYFDV (SEQ ID NO: 1397) |
| VL CDR Seq. #1 | VL CDR1 | KSSQSVLYSSNQKNYLA (SEQ ID NO: 1437) | QSVLYSSNQKNY (SEQ ID NO: 1438) | KSSQSVLYSSNQKNYLA (SEQ ID NO: 1437) | SQSVLYSSNQKNY (SEQ ID NO: 1439) | LYSSNQKNYLAWY (SEQ ID NO: 1450) | KSSQSVLYSSNQKNYLA (SEQ ID NO: 1437) |
|  | VL CDR2 | WASTRES (SEQ ID NO: 1526) | WAS (SEQ ID NO: 1527) | WASTRES (SEQ ID NO: 1526) | WAS (SEQ ID NO: 1527) | LLIYWASTRE (SEQ ID NO: 1528) | WASTRES (SEQ ID NO: 1526) |
|  | VL CDR3 | HQFLSSYT (SEQ ID NO: 1523) | HQFLSSYT (SEQ ID NO: 1523) | HQFLSSYT (SEQ ID NO: 1523) | FLSSY (SEQ ID NO: 1524) | HQFLSSY (SEQ ID NO: 1525) | HQFLSSYT (SEQ ID NO: 1523) |
| VL CDR Seq. #2 | VL CDR1 | SASSSVSSSNLH (SEQ ID NO: 1451) | SSVSSSN (SEQ ID NO: 1452) | SASSSVSSSNLH (SEQ ID NO: 1451) | SSVSSSN (SEQ ID NO: 1453) | SSSNLHWY (SEQ ID NO: 1915) | SASSSVSSSNLH (SEQ ID NO: 1451) |
|  | VL CDR2 | RTSNLAS (SEQ ID NO: 1479) | RTS (SEQ ID NO: 1480) | RTSNLAS (SEQ ID NO: 1479) | RTS (SEQ ID NO: 1480) | FWIYRTSNLA (SEQ ID NO: 1481) | RTSNLAS (SEQ ID NO: 1479) |
|  | VL CDR3 | QQWSGYPRT (SEQ ID NO: 1502) | QQWSGYPRT (SEQ ID NO: 1502) | QQWSGYPRT (SEQ ID NO: 1502) | WSGYPR (SEQ ID NO: 1503) | QQWSGYPR (SEQ ID NO: 1504) | QQWSGYPRT (SEQ ID NO: 1502) |

VH Sequence:
EVQLQQSGPELEKPGASVKISCKASGYSFTGYNMNWVKQSNGKSLEWIGNIDPYYGSASYNQKFKGKATLTVDKSSTTAYMQLKSLTSEDSAVYYCTRSNYGYYGYFDVWGAGTTVTSS (SEQ ID NO: 1268)

VL Sequence #1:
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQFLSSYTFGGGTKLEMK (SEQ ID NO: 1269)

VL Sequence #2:
ENVLTQSPAIMAASPGEKVTMTCSASSSVSSSNLHWYQQKSGTSTKFWIYRTSNLASEVPAPFSGSGSGTSYSLTISSVEAEDAATYYCQQWSGYPRTFGGGTKLEIK (SEQ ID NO: 1270)

*Exemplary CDR sequences encompass amino acids as determined by Kabat plus Chothia.

TABLE 21

Antibody 230A-CDR Sequences

|  |  | Exemplary* | IMGT | Kabat | Chothia | Contact | AbM |
|---|---|---|---|---|---|---|---|
| VH CDR Seq. | VH CDR1 | GYSFTGSNMN (SEQ ID NO: 1301) | GYSFTGSN (SEQ ID NO: 1302) | GSNMN (SEQ ID NO: 1303) | GYSFTGS (SEQ ID NO: 1304) | TGSNMN (SEQ ID NO: 1305) | GYSFTGSNMN (SEQ ID NO: 1301) |
|  | VH CDR2 | NIDPYYGYTTYN QKFKG (SEQ ID NO: 1364) | IDPYYGYT (SEQ ID NO: 1365) | NIDPYYGYTTYN QKFKG (SEQ ID NO: 1364) | PYYG (SEQ ID NO: 1361) | WIGNIDPYYGYTT (SEQ ID NO: 1366) | NIDPYYGYTT (SEQ ID NO: 1367) |
|  | VH CDR3 | DYDYALGYFDV (SEQ ID NO: 1401) | ARDYDYALGYFDV (SEQ ID NO: 1402) | DYDYALGYFDV (SEQ ID NO: 1401) | YDYALGYFD (SEQ ID NO: 1403) | ARDYDYALGYFD (SEQ ID NO: 1404) | DYDYALGYFDV (SEQ ID NO: 1401) |
| VL CDR Seq. | VL CDR1 | RSSQSLVHSNGNTYLH (SEQ ID NO: 1454) | QSLVHSNGNTY (SEQ ID NO: 1455) | RSSQSLVHSNGNTYLH (SEQ ID NO: 1454) | SQSLVHSNGNTY (SEQ ID NO: 1456) | VHSNGNTYLHWY (SEQ ID NO: 1457) | RSSQSLVHSNGNTYLH (SEQ ID NO: 1454) |
|  | VL CDR2 | KVSNRFS (SEQ ID NO: 40) | KVS (SEQ ID NO: 1103) | KVSNRFS (SEQ ID NO: 40) | KVS (SEQ ID NO: 1103) | LLIYKVSNRF (SEQ ID NO: 1114) | KVSNRFS (SEQ ID NO: 40) |

TABLE 21-continued

Antibody 230A-CDR Sequences

| | | | | | | |
|---|---|---|---|---|---|---|
| VL CDR3 | SQSTHVPYT (SEQ ID NO: 1505) | SQSTHVPYT (SEQ ID NO: 1505) | SQSTHVPYT (SEQ ID NO: 1505) | STHVPY (SEQ ID NO: 1506) | SQSTHVPY (SEQ ID NO: 1507) | SQSTHVPYT (SEQ ID NO: 1505) |

VH Sequence:
EVQLQQSGPELEKPGASVKISCKASGYSFTGSNMNVVVKQNNGKSLEWIGNIDPYYGYTTYNQKFKGKATLTVDKSSSTAYMQLKSLTSEDSAVYY
CARDYDYALGYFDVWGAGTTVTVSS (SEQ ID NO: 1271)

VL Sequence:
DVVMTQTPLSLPVSLGDQASISCRSSQSLVHSNGNTYLHVVYLQKPGQSPKLLIYKVSNRFSGVPDRFSGSGSGTDFTLKISRVEAEDLGVYFCSQS
THVPYTFGGGTKLEIK (SEQ ID NO: 1272)

*Exemplary CDR sequences encompass amino acids as determined by Kabat plus Chothia.

TABLE 22

Antibody 76E1-CDR Sequences

| | | Exemplary* | IMGT | Kabat | Chothia | Contact | AbM |
|---|---|---|---|---|---|---|---|
| VH CDR Seq. | VH CDR1 | GYSFTGYNMN (SEQ ID NO. 30) | GYSFTGYN (SEQ ID NO. 1099) | GYNMN (SEQ ID NO. 1104) | GYSFTGY (SEQ ID NO. 1105) | TGYNMN (SEQ ID NO. 1110) | GYSFTGYNMN (SEQ ID NO. 30) |
| | VH CDR2 | NIDPYYDTSYN LKFKD (SEQ ID NO. 31) | IDPYYDT (SEQ ID NO. 1100) | NIDPYYDTSYN LKFKD (SEQ ID NO. 31) | PYYD (SEQ ID NO. 1106) | WIGNIDPYYDTS (SEQ ID NO. 1111) | NIDPYYDYTS (SEQ ID NO. 1116) |
| | VH CDR3 | STMITPFDY (SEQ ID NO. 32) | ATSTMITPFDY (SEQ ID NO. 1101) | STMITPFDY (SEQ ID NO. 32) | TMITPFD (SEQ ID NO. 1107) | ATSTMITPFD (SEQ ID NO. 1112) | STMITPFDY (SEQ ID NO. 32) |
| VL CDR Seq. | VL CDR1 | RSSQSIVHSNGN TYLE (SEQ ID NO. 45) | QSIVHSNGNTY (SEQ ID NO. 1102) | RSSQSIVHSNGN TYLE (SEQ ID NO. 45) | SQSIVHSNGNTY (SEQ ID NO. 1108) | VHSNGNTYLEWY (SEQ ID NO. 1113) | RSSQSIVHSNGN TYLE (SEQ ID NO. 45) |
| | VL CDR2 | KVSNRFS (SEQ ID NO. 40) | KVS (SEQ ID NO. 1103) | KVSNRFS (SEQ ID NO. 40) | KVS (SEQ ID NO. 1103) | LLIYKVSNRF (SEQ ID NO. 1114) | KVSNRFS (SEQ ID NO. 40) |
| | VL CDR3 | FQGSHVPWT (SEQ ID NO. 41) | FQGSHVPWT (SEQ ID NO. 41) | FQGSHVPWT (SEQ ID NO. 41) | GSHVPW (SEQ ID NO. 1109) | FQGSHVPW (SEQ ID NO. 1115) | FQGSHVPWT (SEQ ID NO. 41) |

VH Sequence:
EVQLLQSGPELEKPGASVKISCKASGYSFTGYNMNWVKQSNGKSLEWIGNIDPYYDYTSYNLKFKDKATLTVDKSSSTAYMQLKSLTSEDSAVYY
CATSTMITPFDYWGQGTTLTVSS (SEQ ID NO: 1)

VL Sequence:
DVLMTQTPLSLPVSLGDQASISCRSSQSIVHSNGNTYLEWYLQKPGQSPKLLIYKVSNRFSGVPDRFSGSGSGTDFTLKINRVEAEDLGVYYCFQG
SHVPWTFGGGTKLEIK (SEQ ID NO: 4)

*Exemplary CDR sequences encompass amino acids as determined by Kabat plus Chothia.

TABLE 23

Antibody 53A-CDR Sequences

| | | Exemplary* | IMGT | Kabat | Chothia | Contact | AbM |
|---|---|---|---|---|---|---|---|
| VH CDR Seq. | VH CDR1 | GYTFTSYFMH (SEQ ID NO: 1306) | GYTFTSYF (SEQ ID NO: 1307) | SYFMH (SEQ ID NO: 1308) | GYTFTSY (SEQ ID NO: 1309) | TSYFMH (SEQ ID NO: 1310) | GYTFTSYFMH (SEQ ID NO: 1306) |
| | VH CDR2 | YIYPYNDGTKYN EKFKG (SEQ ID NO: 1368) | IYPYNDGT (SEQ ID NO: 1369) | YIYPYNDGTKYN EKFKG (SEQ ID NO: 1368) | PYND (SEQ ID NO: 1370) | WIGYIYPYNDGTK (SEQ ID NO: 1371) | YIYPYNDGTK (SEQ ID NO: 1372) |
| | VH CDR3 | FDYDTLRY (SEQ ID NO: 1405) | ARFDYDTLRY (SEQ ID NO: 1406) | FDYDTLRY (SEQ ID NO: 1405) | DYDTLR (SEQ ID NO: 1407) | ARFDYDTLR (SEQ ID NO: 1408) | FDYDTLRY (SEQ ID NO: 1405) |
| VL CDR Seq. | VL CDR1 | KSTKSLLNSDGF TYLD (SEQ ID NO: 1458) | KSLLNSDGFTY (SEQ ID NO: 1459) | KSTKSLLNSDGF TYLD (SEQ ID NO: 1458) | TKSLLNSDGFTY (SEQ ID NO: 1460) | LNSDGFTYLDWY (SEQ ID NO: 1461) | KSTKSLLNSDGF TYLD (SEQ ID NO: 1458) |

TABLE 23-continued

Antibody 53A-CDR Sequences

| | | | | | | |
|---|---|---|---|---|---|---|
| VL CDR2 | LVSNRFS (SEQ ID NO: 1482) | LVS (SEQ ID NO: 1483) | LVSNRFS (SEQ ID NO: 1482) | LVS (SEQ ID NO: 1483) | LLIYLVSNRF (SEQ ID NO: 1484) | LVSNRFS (SEQ ID NO: 1482) |
| VL CDR3 | FQSNYFPWT (SEQ ID NO: 1508) | FQSNYFPWT (SEQ ID NO: 1508) | FQSNYFPWT (SEQ ID NO: 1508) | SNYFPW (SEQ ID NO: 1509) | FQSNYFPW (SEQ ID NO: 1510) | FQSNYFPWT (SEQ ID NO: 1508) |

VH Sequence:
EVQLQQSGPELVKPGASVKMSCKASGYTFTSYFMHWVKQKPGQGLEWIGYIYPYNDGTKYNEKFKGKATLTSDK
SSSTAYMELSSLTSEDSAVYYCARFDYDTLRYWGQGTTLTVSS (SEQ ID NO: 1273)

VL Sequence:
DVVLTQTPLSLPVNIGDQASISCKSTKSLLNSDGFTYLDWYLQKPGQSPQLLIYLVSNRFSGVPDRFSGSGSGT
DFTLKISRVEAEDLGVYYCFQSNYFPWTFGGGTKLEIK (SEQ ID NO: 1274)

*Exemplary CDR sequences encompass amino acids as determined by Kabat plus Chothia.

TABLE 24

Antibody 259A-CDR Sequences

| | | Exemplary* | IMGT | Kabat | Chothia | Contact | AbM |
|---|---|---|---|---|---|---|---|
| VH CDR Seq. | VH CDR1 | GYTFTSYFMH (SEQ ID NO: 1306) | GYTFTSYF (SEQ ID NO: 1307) | SYFMH (SEQ ID NO: 1308) | GYTFTSY (SEQ ID NO: 1309) | TSYFMH (SEQ ID NO: 1310) | GYTFTSYFMH (SEQ ID NO: 1306) |
| | VH CDR2 | YIYPYNDGTKYN EKFKG (SEQ ID NO: 1368) | IYPYNDGT (SEQ ID NO: 1369) | YIYPYNDGTKYN EKFKG (SEQ ID NO: 1368) | PYND (SEQ ID NO: 1370) | WIGYIYPYNDGTK (SEQ ID NO: 1371) | YIYPYNDGTK (SEQ ID NO: 1372) |
| | VH CDR3 | FDYDTLRY (SEQ ID NO: 1405) | ARFDYDTLRY (SEQ ID NO: 1406) | FDYDTLRY (SEQ ID NO: 1405) | DYDTLR (SEQ ID NO: 1407) | ARFDYDTLRY (SEQ ID NO: 1408) | FDYDTLRY (SEQ ID NO: 1405) |
| VL CDR Seq. | VL CDR1 | KSTKSLLNSDGF TYLD (SEQ ID NO: 1458) | KSLLNSDGFTY (SEQ ID NO: 1459) | KSTKSLLNSDGF TYLD (SEQ ID NO: 1458) | TKSLLNSDGFTY (SEQ ID NO: 1460) | LNSDGFTYLDWY (SEQ ID NO: 1461) | KSTKSLLNSDGF TYLD (SEQ ID NO: 1458) |
| | VL CDR2 | LISNRFS (SEQ ID NO: 1485) | LIS (SEQ ID NO: 1486) | LISNRFS (SEQ ID NO: 1485) | LIS (SEQ ID NO: 1486) | LLIYLISNRF (SEQ ID NO: 1487) | LISNRFS (SEQ ID NO: 1485) |
| | VL CDR3 | FQSNYFPWT (SEQ ID NO: 1508) | FQSNYFPWT (SEQ ID NO: 1508) | FQSNYFPWT (SEQ ID NO: 1508) | SNYFPW (SEQ ID NO: 1509) | FQSNYFPW (SEQ ID NO: 1510) | FQSNYFPWT (SEQ ID NO: 1508) |

VH Sequence:
EVQLQQSGPELVKPGASVKMSCKASGYTFTSYFMHWVKQKPGQGLEWIGYIYPYNDGTKYNEKFKGKATLTS
DKSSSTAYMDLSSLTSEDSAVYYCARFDYDTLRYWGQGTTLTVSS (SEQ ID NO: 1275)

VL Sequence:
DVVLTQTPLSLPVNIGDQASISCKSTKSLLNSDGFTYLDWYLQKPGQSPQLLIYLISNRFSGVPDRFSGSGS
GTDFTLKISRVEAEDLGVYYCFQSNYFPWTFGGGTKLEIK (SEQ ID NO: 1276)

*Exemplary CDR sequences encompass amino acids as determined by Kabat plus Chothia.

TABLE 25

Antibody 33A-CDR Sequences

| | | Exemplary* | IMGT | Kabat | Chothia | Contact | AbM |
|---|---|---|---|---|---|---|---|
| VH CDR Seq. | VH CDR1 | GYTFSSYWIE (SEQ ID NO: 1311) | GYTFSSYW (SEQ ID NO: 1312) | SYWIE (SEQ ID NO: 1313) | GYTFSSY (SEQ ID NO: 1314) | SSYWIE (SEQ ID NO: 1315) | GYTFSSYWIE (SEQ ID NO: 1311) |
| | VH CDR2 | EILPGSGSTSYN EKFKG (SEQ ID NO: 37) | ILPGSGST (SEQ ID NO: 1082) | EILPGSGSTSYN EKFKG (SEQ ID NO: 37) | PGSG (SEQ ID NO: 1088) | WIGEILPGSGSTS (SEQ ID NO: 1093) | EILPGSGSTS (SEQ ID NO: 1098) |
| | VH CDR3 | WLLYYYAMVY (SEQ ID NO: 1409) | ARWLLYYYAMVY (SEQ ID NO: 1410) | WLLYYYAMVY (SEQ ID NO: 1409) | LLYYYAMV (SEQ ID NO: 1411) | ARWLLYYYAMV (SEQ ID NO: 1412) | WLLYYYAMVY (SEQ ID NO: 1409) |

TABLE 25-continued

Antibody 33A-CDR Sequences

| VL CDR Seq. | VL CDR1 | RSSQSIVHSNGN TYLE (SEQ ID NO: 45) | QSIVHSNGNTY (SEQ ID NO: 1102) | RSSQSIVHSNGN TYLE (SEQ ID NO: 45) | SQSIVHSNGNTY (SEQ ID NO: 1108) | VHSNGNTYLEWY (SEQ ID NO: 1113) | RSSQSIVHSNGN TYLE (SEQ ID NO: 45) |
|---|---|---|---|---|---|---|---|
| | VL CDR2 | KVSNRFS (SEQ ID NO: 40) | KVS (SEQ ID NO: 1103) | KVSNRFS (SEQ ID NO: 40) | KVS (SEQ ID NO: 1103) | LLIYKVSNRF (SEQ ID NO: 1114) | KVSNRFS (SEQ ID NO: 40) |
| | VL CDR3 | FQGSHVPYT (SEQ ID NO: 1511) | FQGSHVPYT (SEQ ID NO: 1511) | FQGSHVPYT (SEQ ID NO: 1511) | GSHVPY (SEQ ID NO: 1512) | FQGSHVPY (SEQ ID NO: 1513) | FQGSHVPYT (SEQ ID NO: 1511) |

VH Sequence:
QVQLQQSGAELMKPGASVKISCKATGYTFSSYWIEWVKQRPGHGLEWIGEILPGSGSTSYNEKFKGKATFTADTSSNTAYMQLSGLTSEDSAVYY
CARWLLYYYAMVYWGQGTSVTVSS (SEQ ID NO: 1277)

VL Sequence:
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQG
SHVPYTFGGGTKLEIK (SEQ ID NO: 1278)

*Exemplary CDR sequences encompass amino acids as determined by Kabat plus Chothia.

TABLE 26

Antibody 39A-CDR Sequences

| | | Exemplary* | IMGT | Kabat | Chothia | Contact | AbM |
|---|---|---|---|---|---|---|---|
| VH CDR Seq. | VH CDR1 | GYTFSSNWIE (SEQ ID NO: 1316) | GYTFSSNW (SEQ ID NO: 1317) | SNWIE (SEQ ID NO: 1318) | GYTFSSN (SEQ ID NO: 1319) | SSNWIE (SEQ ID NO: 1320) | GYTFSSNWIE (SEQ ID NO: 1316) |
| | VH CDR2 | EILPGSGSTSYN EKFKG (SEQ ID NO: 37) | ILPGSGST (SEQ ID NO: 1082) | EILPGSGSTSYN EKFKG (SEQ ID NO: 37) | PGSG (SEQ ID NO: 1088) | WIGEILPGSGSTS (SEQ ID NO: 1093) | EILPGSGSTS (SEQ ID NO: 1098) |
| | VH CDR3 | WLLYYYAMDY (SEQ ID NO: 38) | ARWLLYYYAMDY (SEQ ID NO: 1083) | WLLYYYAMDY (SEQ ID NO: 38) | LLYYYAMD (SEQ ID NO: 1089) | ARWLLYYYAMD (SEQ ID NO: 1094) | WLLYYYAMDY (SEQ ID NO: 38) |
| VL CDR Seq. | VL CDR1 | RSSQSIVHNNGN TYLE (SEQ ID NO: 1462) | QSIVHNNGNTY (SEQ ID NO: 1463) | RSSQSIVHNNGN TYLE (SEQ ID NO: 1462) | SQSIVHNNGNTY (SEQ ID NO: 1464) | VHNNGNTYLEWY (SEQ ID NO: 1465) | RSSQSIVHNNGN TYLE (SEQ ID NO: 1462) |
| | VL CDR2 | KVSNRFS (SEQ ID NO: 40) | KVS (SEQ ID NO: 1103) | KVSNRFS (SEQ ID NO: 40) | KVS (SEQ ID NO: 1103) | LLIYKVSNRF (SEQ ID NO: 1114) | KVSNRFS (SEQ ID NO: 40) |
| | VL CDR3 | FQGSHVPYT (SEQ ID NO: 1511) | FQGSHVPYT (SEQ ID NO: 1511) | FQGSHVPYT (SEQ ID NO: 1511) | GSHVPY (SEQ ID NO: 1512) | FQGSHVPY (SEQ ID NO: 1513) | FQGSHVPYT (SEQ ID NO: 1511) |

VH Sequence:
QVQLQQSGAELMKPGASVKISCKATGYTFSSNWIEWVKQRPGHGLEWIGEILPGSGSTSYNEKFKGKATFTADTSSNTAYMQLSSLTSEDSAVYY
CARWLLYYYAMDYWGQGTSVTVSS (SEQ ID NO: 1279)

VL Sequence:
DVLMTQTPLSLPVSLGDPASISCRSSQSIVHNNGNTYLEWYLQKPGQSPKLLIYKVSNRFSGVPDRFSGSGSGTDFTLKISRVEAEDLGVYYCFQG
SHVPYTFGGGTKLEIK (SEQ ID NO: 1280)

*Exemplary CDR sequences encompass amino acids as determined by Kabat plus Chothia.

TABLE 27

Antibody 124A-CDR Sequences

| | | Exemplary* | IMGT | Kabat | Chothia | Contact | AbM |
|---|---|---|---|---|---|---|---|
| VH CDR Seq. | VH CDR1 | GYTFSSNWIE (SEQ ID NO: 1316) | GYTFSSNW (SEQ ID NO: 1317) | SNWIE (SEQ ID NO: 1318) | GYTFSSN (SEQ ID NO: 1319) | SSNWIE (SEQ ID NO: 1320) | GYTFSSNWIE (SEQ ID NO: 1316) |
| | VH CDR2 | EILPGSGSTSYN EKFKG (SEQ ID NO: 37) | ILPGSGST (SEQ ID NO: 1082) | EILPGSGSTSYN EKFKG (SEQ ID NO: 37) | PGSG (SEQ ID NO: 1088) | WMGEILPGSGSTS (SEQ ID NO: 1917) | EILPGSGSTS (SEQ ID NO: 1098) |

TABLE 27-continued

Antibody 124A-CDR Sequences

|  |  |  |  |  |  |  |  |
|---|---|---|---|---|---|---|---|
|  | VH CDR3 | WLLYYYAMDF (SEQ ID NO: 1413) | ARWLLYYYAMDF (SEQ ID NO: 1414) | WLLYYYAMDF (SEQ ID NO: 1413) | LLYYYAMD (SEQ ID NO: 1089) | ARWLLYYYAMD (SEQ ID NO: 1094) | WLLYYYAMDF (SEQ ID NO: 1413) |
| VL CDR Seq. | VL CDR1 | RSSQSIVHNNGNTYLE (SEQ ID NO: 1462) | QSIVHNNGNTY (SEQ ID NO: 1463) | RSSQSIVHNNGNTYLE (SEQ ID NO: 1462) | SQSIVHNNGNTY (SEQ ID NO: 1464) | VHNNGNTYLEWY (SEQ ID NO: 1465) | RSSQSIVHNNGNTYLE (SEQ ID NO: 1462) |
|  | VL CDR2 | KVSNRFS (SEQ ID NO: 40) | KVS (SEQ ID NO: 1103) | KVSNRFS (SEQ ID NO: 40) | KVS (SEQ ID NO: 1103) | LLIYKVSNRF (SEQ ID NO: 1114) | KVSNRFS (SEQ ID NO: 40) |
|  | VL CDR3 | FQGSHVPYT (SEQ ID NO: 1511) | FQGSHVPYT (SEQ ID NO: 1511) | FQGSHVPYT (SEQ ID NO: 1511) | GSHVPY (SEQ ID NO: 1512) | FQGSHVPY (SEQ ID NO: 1513) | FQGSHVPYT (SEQ ID NO: 1511) |

VH Sequence:
QVQLQQSGAELMKPGASVKISCKATGYTFSSNWIEWVKQRPGHGLEWMGEILPGSGSTSYNEKFKGKATFTADTSSNTAYMQLSSLTSEDSAVY
YCARWLLYYYAMDFWGQGTSVTVSS (SEQ ID NO: 1281)

VL Sequence:
DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQG
SHVPYTFGGGTKLEIK (SEQ ID NO: 1282)

*Exemplary CDR sequences encompass amino acids as determined by Kabat plus Chothia.

TABLE 28

Antibody 175A-CDR Sequences

|  |  | Exemplary* | IMGT | Kabat | Chothia | Contact | AbM |
|---|---|---|---|---|---|---|---|
| VH CDR Seq. | VH CDR1 | GYTFSTHWIE (SEQ ID NO. 36) | GYTFSTHW (SEQ ID NO. 1081) | THWIE (SEQ ID NO. 1086) | GYTFSTH (SEQ ID NO. 1087) | STHWIE (SEQ ID NO. 1092) | GYTFSTHWIE (SEQ ID NO. 36) |
|  | VH CDR2 | EILPGSGSTSYNEKFKG (SEQ ID NO. 37) | ILPGSGST (SEQ ID NO. 1082) | EILPGSGSTSYNEKFKG (SEQ ID NO. 37) | PGSG (SEQ ID NO. 1088) | WIGEILPGSGSTS (SEQ ID NO. 1093) | EILPGSGSTS (SEQ ID NO. 1098) |
|  | VH CDR3 | WLLYYYAMDY (SEQ ID NO. 38) | ARWLLYYYAMDY (SEQ ID NO. 1083) | WLLYYYAMDY (SEQ ID NO. 38) | LLYYYAMD (SEQ ID NO. 1089) | ARWLLYYYAMD (SEQ ID NO. 1094) | WLLYYYAMDY (SEQ ID NO. 38) |
| VL CDR Seq. | VL CDR1 | RSSQSIVHSNGNTYLE (SEQ ID NO. 45) | QSIVHSNGNTY (SEQ ID NO. 1084) | RSSQSIVHSNGNTYLE (SEQ ID NO. 45) | SQSIVHSNGNTY (SEQ ID NO. 1090) | VHSNGNTYLEWY (SEQ ID NO. 1095) | RSSQSIVHSNGNTYLE (SEQ ID NO. 45) |
|  | VL CDR2 | KLSNRFS (SEQ ID NO. 46) | KLS (SEQ ID NO. 1085) | KLSNRFS (SEQ ID NO. 46) | KLS (SEQ ID NO. 1085) | LLIYKLSNRF (SEQ ID NO. 1096) | KLSNRFS (SEQ ID NO. 46) |
|  | VL CDR3 | FQGSHFPYT (SEQ ID NO. 47) | FQGSHFPYT (SEQ ID NO. 47) | FQGSHFPYT (SEQ ID NO. 47) | GSHFPY (SEQ ID NO. 1091) | FQGSHFPY (SEQ ID NO. 1097) | FQGSHFPYT (SEQ ID NO. 47) |

VH Sequence:
QVQLQQSGAELMKPGASVKISCKATGYTFSTHWIEWVKQRPGHGLEWIGEILPGSGSTSYNEKFKGKATFTADTSSNTAYMQLSSLTSEDSAVYY
CARWLLYYYAMDYWGQGTSVTVSS (SEQ ID NO: 3)

VL Sequence:
DVLMTQTPLSLPVSLGDQASISCRSSQSIVHSNGNTYLEWYLQKPGQSPKLLIYKLSNRFSGVPDRFSGSGSGTDFTLKISRVEAEDLGVYYCFQG
SHFPYTFGGGTKLEIK (SEQ ID NO: 6)

*Exemplary CDR sequences encompass amino acids as determined by Kabat plus Chothia.

TABLE 29

Antibody 321D-CDR Sequences

|  |  | Exemplary* | IMGT | Kabat | Chothia | Contact | AbM |
|---|---|---|---|---|---|---|---|
| VH CDR Seq. | VH CDR1 | GYTFSSHWIE (SEQ ID NO: 1321) | GYTFSSHW (SEQ ID NO: 1322) | SHWIE (SEQ ID NO: 1323) | GYTFSSH (SEQ ID NO: 1324) | SSHWIE (SEQ ID NO: 1325) | GYTFSSHWIE (SEQ ID NO: 1321) |

TABLE 29-continued

Antibody 321D-CDR Sequences

|  |  |  |  |  |  |  |  |
|---|---|---|---|---|---|---|---|
|  | VH CDR2 | EILPGSGSTDYN EKFKG (SEQ ID NO: 849) | ILPGSGST (SEQ ID NO: 1082) | EILPGSGSTDYN EKFKG (SEQ ID NO: 849) | PGSG (SEQ ID NO: 1088) | WIGEILPGSGSTD (SEQ ID NO: 1373) | EILPGSGSTD (SEQ ID NO: 1374) |
|  | VH CDR3 | WLLYYYAMDY (SEQ ID NO: 38) | ARWLLYYYAMDY (SEQ ID NO: 1083) | WLLYYYAMDY (SEQ ID NO: 38) | LLYYYAMD (SEQ ID NO: 1089) | ARWLLYYYAMD (SEQ ID NO: 1094) | WLLYYYAMDY (SEQ ID NO: 38) |
| VL CDR Seq. | VL CDR1 | RSSQSIVHSNGN TYLE (SEQ ID NO: 45) | QSIVHSNGNTY (SEQ ID NO: 1102) | RSSQSIVHSNGN TYLE (SEQ ID NO: 45) | SQSIVHSNGNTY (SEQ ID NO: 1108) | VHSNGNTYLEWY (SEQ ID NO: 1113) | RSSQSIVHSNGN TYLE (SEQ ID NO: 45) |
|  | VL CDR2 | KVSNRFS (SEQ ID NO: 40) | KVS (SEQ ID NO: 1103) | KVSNRFS (SEQ ID NO: 40) | KVS (SEQ ID NO: 1103) | LLIYKVSNRF (SEQ ID NO: 1114) | KVSNRFS (SEQ ID NO: 40) |
|  | VL CDR3 | FQGSHVPFT (SEQ ID NO: 1514) | FQGSHVPFT (SEQ ID NO: 1514) | FQGSHVPFT (SEQ ID NO: 1514) | GSHVPF (SEQ ID NO: 1515) | FQGSHVPF (SEQ ID NO: 1516) | FQGSHVPFT (SEQ ID NO: 1514) |

VH Sequence:
QVQLQQSGAELMKPGAAVKISCKATGYTFSSHWIEWVKQRPGHGLEWIGEILPGSGSTDYNEKFKGKATFTADTSSNTAYMQLSSLTSEDSAVYY
CARWLLYYYAMDYWGQGTSVTVSS (SEQ ID NO: 1283)

VL Sequence:
DVLMTQTPLSLPVSLGDQASISCRSSQSIVHSNGNTYLEWYLQKPGQSPKLLIYKVSNRFSGVPDRFSGSGSGTDFTLKITRVEAEDLGVYYCFQG
SHVPFTFGGGTKLEIK (SEQ ID NO: 1284)

*Exemplary CDR sequences encompass amino acids as determined by Kabat plus Chothia.

TABLE 30

Antibody 141A-CDR Sequences

|  |  | Exemplary* | IMGT | Kabat | Chothia | Contact | AbM |
|---|---|---|---|---|---|---|---|
| VH CDR Seq. | VH CDR1 | GYTFSRYWIE (SEQ ID NO. 33) | GYTFSRYW (SEQ ID NO. 1117) | RYWIE (SEQ ID NO. 1122) | GYTFSRY (SEQ ID NO. 1123) | SRYWIE (SEQ ID NO. 1128) | GYTFSRYWIE (SEQ ID NO. 33) |
|  | VH CDR2 | EILPGSGSTNYN EKFKG (SEQ ID NO. 34) | ILPGSGST (SEQ ID NO. 1118) | EILPGSGSTNYN EKFKG (SEQ ID NO. 34) | PGSG (SEQ ID NO. 1124) | WIGEILPGSGSTN (SEQ ID NO. 1129) | EILPGSGSTN (SEQ ID NO. 1134) |
|  | VH CDR3 | EEVYDGYPWFGY (SEQ ID NO. 35) | AGEEVYDGYPW FGY (SEQ ID NO. 1119) | EEVYDGYPWFGY (SEQ ID NO. 35) | EVYDGYPWFG (SEQ ID NO. 1125) | AGEEVYDGYPW FG (SEQ ID NO. 1130) | EEVYDGYPWFGY (SEQ ID NO. 35) |
| VL CDR Seq. | VL CDR1 | RASSSLSYMH (SEQ ID NO. 42) | SSLSY (SEQ ID NO. 1120) | RASSSLSYMH (SEQ ID NO. 42) | SSSLSY (SEQ ID NO. 1126) | SYMHWY (SEQ ID NO. 1131) | RASSSLSYMH (SEQ ID NO. 42) |
|  | VL CDR2 | ATSNLAS (SEQ ID NO. 43) | ATS (SEQ ID NO. 1121) | ATSNLAS (SEQ ID NO. 43) | ATS (SEQ ID NO. 1121) | PWIYATSNLA (SEQ ID NO. 1132) | ATSNLAS (SEQ ID NO. 43) |
|  | VL CDR3 | QQWSSNPYT (SEQ ID NO. 44) | QQWSSNPYT (SEQ ID NO. 44) | QQWSSNPYT (SEQ ID NO. 44) | WSSNPY (SEQ ID NO. 1127) | QQWSSNPY (SEQ ID NO. 1133) | QQWSSNPYT (SEQ ID NO. 44) |

VH Sequence:
QVQLQQSGAELMKPGASVKISCKATGYTFSRYWIEWVKQRPGHGLEWIGEILPGSGSTNYNEKFKGKATFTADTSSNTAYMQLSSLTSEDSAVYY
CAGEEVYDGYPWFGYWGQGTLVTVSA (SEQ ID NO: 2)

VL Sequence:
QIVLSQSPAILSASPGEKVTMTCRASSSLSYMHWYQQKPGSSPKPWIYATSNLASGVPARFSGSGSGTSYSLTISRVEAEDAATYYCQQWSSNPY
TFGGGTKLEIK (SEQ ID NO: 5)

*Exemplary CDR sequences encompass amino acids as determined by Kabat plus Chothia.

TABLE 31

Antibody 51A-CDR Sequences

|  |  | Exemplary* | IMGT | Kabat | Chothia | Contact | AbM |
|---|---|---|---|---|---|---|---|
| VH CDR Seq. | VH CDR1 | GYTFSRYWIE (SEQ ID NO: 33) | GYTFSRYW (SEQ ID NO: 1117) | RYWIE (SEQ ID NO: 1122) | GYTFSRY (SEQ ID NO: 1123) | SRYWIE (SEQ ID NO: 1128) | GYTFSRYWIE (SEQ ID NO: 33) |

TABLE 31-continued

Antibody 51A-CDR Sequences

|  |  |  |  |  |  |  |  |
|---|---|---|---|---|---|---|---|
| | VH CDR2 | EILPGSGSTNYN EKFKG (SEQ ID NO: 34) | ILPGSGST (SEQ ID NO: 1082) | EILPGSGSTNYN EKFKG (SEQ ID NO: 34) | PGSG (SEQ ID NO: 1088) | WIGEILPGSGSTN (SEQ ID NO: 1129) | EILPGSGSTN (SEQ ID NO: 1134) |
| | VH CDR3 | EEVYDGYPWFGY (SEQ ID NO: 35) | ASEEVYDGYPW FGY (SEQ ID NO: 1415) | EEVYDGYPWFGY (SEQ ID NO: 35) | EVYDGYPWFG (SEQ ID NO: 1125) | ASEEVYDGYPW FG (SEQ ID NO: 1416) | EEVYDGYPWFGY (SEQ ID NO: 35) |
| VL CDR Seq. | VL CDR1 | RASSSLSYMH (SEQ ID NO: 42) | SSLSY (SEQ ID NO: 1120) | RASSSLSYMH (SEQ ID NO: 42) | SSSLSY (SEQ ID NO: 1126) | SYMHWY (SEQ ID NO: 1131) | RASSSLSYMH (SEQ ID NO: 42) |
| | VL CDR2 | ATSNLAS (SEQ ID NO: 43) | ATS (SEQ ID NO: 1121) | ATSNLAS (SEQ ID NO: 43) | ATS (SEQ ID NO: 1121) | PWIYATSNLA (SEQ ID NO: 1132) | ATSNLAS (SEQ ID NO: 43) |
| | VL CDR3 | QQWSSNPYT (SEQ ID NO: 44) | QQWSSNPYT (SEQ ID NO: 44) | QQWSSNPYT (SEQ ID NO: 44) | WSSNPY (SEQ ID NO: 1127) | QQWSSNPY (SEQ ID NO: 1133) | QQWSSNPYT (SEQ ID NO: 44) |

VH Sequence:
QVQLQQSGAELMKPGASVKISCKATGYTFSRYWIEWVKQRPGHGLEWIGEILPGSGSTNYNEKFKGKATFTADTSSNTAYMQLSSLTSEDSAVYY
CASEEVYDGYPWFGYWGQGTLVTVSA (SEQ ID NO: 1285)

VL Sequence:
QIVLSQSPAILSASPGEKVTMTCRASSSLSYMHWYQQRPGSSPKPWIYATSNLASGVPARFSGSGSGTSYSLTISRVEAEDAATYYCQQWSSNPY
TFGGGTKLEIK (SEQ ID NO: 1286)

*Exemplary CDR sequences encompass amino acids as determined by Kabat plus Chothia.

TABLE 32

Antibody 353A-CDR Sequences

| | | Exemplary* | IMGT | Kabat | Chothia | Contact | AbM |
|---|---|---|---|---|---|---|---|
| VH CDR Seq. | VH CDR1 | GFDFSRYWMN (SEQ ID NO: 1326) | GFDFSRYW (SEQ ID NO: 1327) | RYWMN (SEQ ID NO: 1328) | GFDFSRY (SEQ ID NO: 1329) | SRYWMN (SEQ ID NO: 1330) | GFDFSRYWMN (SEQ ID NO: 1326) |
| | VH CDR2 | EINPDSSTINYTP SLKD (SEQ ID NO: 1375) | INPDSSTI (SEQ ID NO: 1376) | EINPDSSTINYTP SLKD (SEQ ID NO: 1375) | PDSS (SEQ ID NO: 1377) | WIGEINPDSSTIN (SEQ ID NO: 1378) | EINPDSSTIN (SEQ ID NO: 1379) |
| | VH CDR3 | PGEIYYYGSYWF AY (SEQ ID NO: 1417) | ARPGEIYYYGSY WFAY (SEQ ID NO: 1418) | PGEIYYYGSYWF AY (SEQ ID NO: 1417) | GEIYYYGSYWFA (SEQ ID NO: 1419) | ARPGEIYYYGSY WFA (SEQ ID NO: 1420) | PGEIYYYGSYWF AY (SEQ ID NO: 1417) |
| VL CDR Seq. | VL CDR1 | RASESVEYYGTS LMQ (SEQ ID NO: 1466) | ESVEYYGTSL (SEQ ID NO: 1467) | RASESVEYYGTS LMQ (SEQ ID NO: 1468) | SESVEYYGTSL (SEQ ID NO: 1468) | EYYGTSLMQWF (SEQ ID NO: 1924) | RASESVEYYGTS LMQ (SEQ ID NO: 1466) |
| | VL CDR2 | AASNVES (SEQ ID NO: 1488) | AAS (SEQ ID NO: 1489) | AASNVES (SEQ ID NO: 1488) | AAS (SEQ ID NO: 1489) | LLIYAASNVE (SEQ ID NO: 1490) | AASNVES (SEQ ID NO: 1488) |
| | VL CDR3 | QQSRKDPWT (SEQ ID NO: 1517) | QQSRKDPWT (SEQ ID NO: 1517) | QQSRKDPWT (SEQ ID NO: 1517) | SRKDPW (SEQ ID NO: 1518) | QQSRKDPW (SEQ ID NO: 1519) | QQSRKDPWT (SEQ ID NO: 1517) |

VH Sequence:
EVKLLESGGGLVQPGGSLKLSCAASGFDFSRYWMNWVRQAPGKGLEWIGEINPDSSTINYTPSLKDKFIISRDNAKNTLYLQMS
KVRYEDTALYYCARPGEIYYYGSYWFAYWGQGTLVTVSA (SEQ ID NO: 1287)

VL Sequence:
DIVLTQSPASLAVSLGQRATISCRASESVEYYGTSLMQWFQQKPGQPPKLLIYAASNVESRVPARFSGSGSGTDFSLNIHPVEE
DDIAMYFCQQSRKDPWTFGGGTKLEIK (SEQ ID NO: 1288)

*Exemplary CDR sequences encompass amino acids as determined by Kabat plus Chothia.

TABLE 33

Antibody 305A-CDR Sequences

|  |  | Exemplary* | IMGT | Kabat | Chothia | Contact | AbM |
|---|---|---|---|---|---|---|---|
| VH CDR Seq. | VH CDR1 | GYSITSGYYWN (SEQ ID NO: 1331) | GYSITSGYY (SEQ ID NO: 1332) | SGYYWN (SEQ ID NO: 1333) | GYSITSGY (SEQ ID NO: 1334) | TSGYYWN (SEQ ID NO: 1335) | GYSITSGYYWN (SEQ ID NO: 1331) |
|  | VH CDR2 | YISYDGSNNYNPSLKN (SEQ ID NO: 1380) | ISYDGSN (SEQ ID NO: 1381) | YISYDGSNNYNPSLKN (SEQ ID NO: 1380) | YDG (SEQ ID NO: 1382) | WMGYISYDGSNN (SEQ ID NO: 1383) | YISYDGSNN (SEQ ID NO: 1384) |
|  | VH CDR3 | RHDYLSFAY (SEQ ID NO: 1421) | ARRHDYLSFAY (SEQ ID NO: 1422) | RHDYLSFAY (SEQ ID NO: 1421) | HDYLSFA (SEQ ID NO: 1423) | ARRHDYLSFA (SEQ ID NO: 1424) | RHDYLSFAY (SEQ ID NO: 1421) |
| VL CDR Seq. | VL CDR1 | KASQSVDYDGDSYMN (SEQ ID NO: 1469) | QSVDYDGDSY (SEQ ID NO: 1470) | KASQSVDYDGDSYMN (SEQ ID NO: 1469) | SQSVDYDGDSY (SEQ ID NO: 1471) | DYDGDSYMNWY (SEQ ID NO: 1472) | KASQSVDYDGDSYMN (SEQ ID NO: 1469) |
|  | VL CDR2 | AASNLES (SEQ ID NO: 1491) | AAS (SEQ ID NO: 1489) | AASNLES (SEQ ID NO: 1491) | AAS (SEQ ID NO: 1489) | LLIYAASNLE (SEQ ID NO: 1492) | AASNLES (SEQ ID NO: 1491) |
|  | VL CDR3 | QQSDEDPYT (SEQ ID NO: 1520) | QQSDEDPYT (SEQ ID NO: 1520) | QQSDEDPYT (SEQ ID NO: 1520) | SDEDPY (SEQ ID NO: 1521) | QQSDEDPY (SEQ ID NO: 1522) | QQSDEDPYT (SEQ ID NO: 1520) |

VH Sequence:
DVQLQESGPGLVKPSQSLSLTCSVTGYSITSGYYWNWIRQFPGNKLEWMGYISYDGSNNYNPSLKNRISITRDTS
KNQFFLKLNSVTTEDTATYYCARRHDYLSFAYWGQGTLVIVSA (SEQ ID NO: 1289)

VL Sequence:
DIVLTQSPASLAVSLGQRATISCKASQSVDYDGDSYMNWYQQKPGQPPKLLIYAASNLESGIPARFSGSGSGTDF
TLNIHPVEEEDAATYYCQQSDEDPYTFGGGTKLEIK (SEQ ID NO: 1290)

*Exemplary CDR sequences encompass amino acids as determined by Kabat plus Chothia.

In certain embodiments, an antibody that binds to C10orf54 (e.g., C10orf54 polypeptide, C10orf54 polypeptide fragment, C10orf54 epitope) comprises: a VH region comprising: (1) a VH CDR1 having an amino acid sequence selected from the group consisting of SEQ ID NOS: 30, 33, 36, 1081, 1086, 1087, 1092, 1099, 1104, 1105, 1110, 1117, 1122, 1123, 1128, 1291-1335, and 1717-1720; (2) a VH CDR2 having an amino acid sequence selected from the group consisting of SEQ ID NOS: 31, 34, 37, 849, 1082, 1088, 1092, 1093, 1098, 1100, 1106, 1111, 1118, 1124, 1129, 1134, 1161, 1336-1344, 1348-1384, 1556-1559, 1829-1847, and 1917; and (3) a VH CDR3 having an amino acid sequence selected from the group consisting of SEQ ID NOS: 32, 35, 38, 1083, 1089, 1094, 1101, 1107, 1112, 1119, 1125, 1130, and 1385-1424.

In certain embodiments, an antibody that binds to C10orf54 (e.g., C10orf54 polypeptide, C10orf54 polypeptide fragment, C10orf54 epitope) comprises: a VL region comprising: (1) a VL CDR1 having an amino acid sequence selected from the group consisting of SEQ ID NOS: 42, 45, 253-271, 1084, 1090, 1095, 1102, 1108, 1113, 1120, 1126, 1131, 1425-1472, 1681-1684, 1744-1822, 1878-1896, and 1915; (2) a VL CDR2 having an amino acid sequence selected from the group consisting of SEQ ID NOS: 40, 43, 46, 157, 843-846, 1085, 1096, 1103, 1114, 1121, 1132, 1473-1492, 1526-1528, 1630-1633, 1685-1688, and 1898-1900; and (3) a VL CDR3 having an amino acid sequence selected from the group consisting of SEQ ID NOS: 41, 44, 47, 1091, 1097, 1109, 1115, 1127, 1133, and 1493-1525.

In certain embodiments, the antibody comprises (a) a VH region comprising: (1) a VH CDR1 having an amino acid sequence selected from the group consisting of SEQ ID NOS: 30, 33, 36, 1081, 1086, 1087, 1092, 1099, 1104, 1105, 1110, 1117, 1122, 1123, 1128, 1291-1335, and 1717-1720; (2) a VH CDR2 having an amino acid sequence selected from the group consisting of SEQ ID NOS: 31, 34, 37, 849, 1082, 1088, 1092, 1093, 1098, 1100, 1106, 1111, 1118, 1124, 1129, 1134, 1161, 1336-1344, 1348-1384, 1556-1559, 1829-1847, and 1917; and (3) a VH CDR3 having an amino acid sequence selected from the group consisting of SEQ ID NOS: 32, 35, 38, 1083, 1089, 1094, 1101, 1107, 1112, 1119, 1125, 1130, and 1385-1424; and (b) a VL region comprising: (1) a VL CDR1 having an amino acid sequence selected from the group consisting of SEQ ID NOS: 42, 45, 253-271, 1084, 1090, 1095, 1102, 1108, 1113, 1120, 1126, 1131, 1425-1472, 1681-1684, 1744-1822, 1878-1896, and 1915; (2) a VL CDR2 having an amino acid sequence selected from the group consisting of SEQ ID NOS: 40, 43, 46, 157, 843-846, 1085, 1096, 1103, 1114, 1121, 1132, 1473-1492, 1526-1528, 1630-1633, 1685-1688, and 1898-1900; and (3) a VL CDR3 having an amino acid sequence selected from the group consisting of SEQ ID NOS: 41, 44, 47, 1091, 1097, 1109, 1115, 1127, 1133, and 1493-1525.

To the extent an antibody provided herein is the to "bind to a C10orf54 epitope", it is envisioned those antibodies also bind to a C10orf54 polypeptide, polypeptide fragment, or antigen thereof.

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC10 (SEQ ID NO: 1251), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), and CC9 (SEQ ID NO: 1250). In some aspects, the antibody comprises: (a) a heavy chain variable (VH) region comprising: (1) a VH CDR1 having an amino acid sequence selected from the group consisting of SEQ ID NOS: 30, 1099, 1104, 1105, 1110, 1291-1305, 1311-1315, and 1321-1325; (2) a VH CDR2 having an amino acid sequence selected from the group consisting of SEQ ID NOS: 37, 849, 1082, 1088, 1093, 1098, 1336-1344, 1348-1367, 1373, 1374, and 1556-1559; and (3) a VH CDR3 having an amino acid sequence selected from the group consisting of SEQ ID NOS: 38, 1083, 1089, 1094, 1385-1404, and 1409-1412; and/or (b) a light chain variable (VL) region comprising: (1) a VL CDR1 having an amino acid sequence selected from the group consisting of SEQ ID NOS: 45, 1102, 1108, 1113, 1425-1430, 1432-1457, 1681-1684, and 1915; (2) a VL CDR2 having an amino acid sequence selected from the group consisting of SEQ ID NOS: 40, 157, 1103, 1114, 1473-1481, 1526-1528, 1630-1633, and 1685-1688; and (3) a VL CDR3 having an amino acid sequence selected from the group consisting of SEQ ID NOS: 1493-1507, 1511-1516, and 1523-1525. In some aspects, the antibody comprises: (a) a VH region comprising: (1) a VH CDR1 having an amino acid sequence of SEQ ID NO: 1291, 1292, 1293, 1294, or 1295; (2) a VH CDR2 having an amino acid sequence of SEQ ID NO: 1336, 1337, 1338, 1339, or 1340; and (3) a VH CDR3 having an amino acid sequence of SEQ ID NO: 1385, 1386, 1387, or 1388; and (b) a VL region comprising: (1) a VL CDR1 having an amino acid sequence of SEQ ID NO: 1425, 1426, 1427, or 1428; (2) a VL CDR2 having an amino acid sequence of SEQ ID NO: 1473, 1474, or 1475; and (3) a VL CDR3 having an amino acid sequence of SEQ ID NO: 1493, 1494, or 1495. In some aspects, the antibody comprises: (a) a VH region comprising: (1) a VH CDR1 having an amino acid sequence of SEQ ID NO: 1291, 1292, 1293, 1294, or 1295; (2) a VH CDR2 having an amino acid sequence of SEQ ID NO: 1341, 1342, 1338, 1343, or 1344; and (3) a VH CDR3 having an amino acid sequence of SEQ ID NO: 1389, 1390, 1391, or 1392; and (b) a VL region comprising: (1) a VL CDR1 having an amino acid sequence of SEQ ID NO: 1425, 1426, 1427, or 1428; (2) a VL CDR2 having an amino acid sequence of SEQ ID NO: 1473, 1474, or 1475; and (3) a VL CDR3 having an amino acid sequence of SEQ ID NO: 1496, 1497, or 1498. In some aspects, the antibody comprises: (a) a VH region comprising: (1) a VH CDR1 having an amino acid sequence of SEQ ID NO: 1291, 1292, 1293, 1294, or 1295; (2) a VH CDR2 having an amino acid sequence of SEQ ID NO: 1348, 1337, 1338, 1349, or 1350; and (3) a VH CDR3 having an amino acid sequence of SEQ ID NO: 1385, 1386, 1387, or 1388; and (b) a VL region comprising: (1) a VL CDR1 having an amino acid sequence of SEQ ID NO: 1429, 1426, 1427, 1430, 1681, 1682, 1683, or 1684; (2) a VL CDR2 having an amino acid sequence of SEQ ID NO: 1473, 1474, 1475, 1685, 1686, 1687, or 1688; and (3) a VL CDR3 having an amino acid sequence of SEQ ID NO: 1493, 1494, or 1495. In some aspects, the antibody comprises: (a) a VH region comprising: (1) a VH CDR1 having an amino acid sequence of SEQ ID NO: 1291, 1292, 1293, 1294, or 1295; (2) a VH CDR2 having an amino acid sequence of SEQ ID NO: 1348, 1337, 1338, 1349, or 1350; and (3) a VH CDR3 having an amino acid sequence of SEQ ID NO: 1385, 1386, 1387, or 1388; and (b) a VL region comprising: (1) a VL CDR1 having an amino acid sequence of SEQ ID NO: 1429, 1426, 1427, or 1430; (2) a VL CDR2 having an amino acid sequence of SEQ ID NO: 1473, 1474, or 1475; and (3) a VL CDR3 having an amino acid sequence of SEQ ID NO: 1493, 1494, or 1495. In some aspects, the antibody comprises: (a) a VH region comprising: (1) a VH CDR1 having an amino acid sequence of SEQ ID NO: 1291, 1292, 1293, 1294, or 1295; (2) a VH CDR2 having an amino acid sequence of SEQ ID NO: 1351, 1337, 1338, 1352, or 1353; and (3) a VH CDR3 having an amino acid sequence of SEQ ID NO: 1385, 1386, 1387, or 1388; and (b) a VL region comprising: (1) a VL CDR1 having an amino acid sequence of SEQ ID NO: 1425, 1426, 1427, or 1428; (2) a VL CDR2 having an amino acid sequence of SEQ ID NO: 1473, 1474, or 1475; and (3) a VL CDR3 having an amino acid sequence of SEQ ID NO: 1493, 1494, or 1495. In some aspects, the antibody comprises: (a) a VH region comprising: (1) a VH CDR1 having an amino acid sequence of SEQ ID NO: 30, 1099, 1104, 1105, or 1110; (2) a VH CDR2 having an amino acid sequence of SEQ ID NO: 1359, 1360, 1361, 1362, or 1363; and (3) a VH CDR3 having an amino acid sequence of SEQ ID NO: 1397, 1398, 1399, or 1400; and (b) a VL region comprising: (1) a VL CDR1 having an amino acid sequence of SEQ ID NO: 1437, 1451, 1438, 1452, 1451 1439, 1453, 1450, or 1915; (2) a VL CDR2 having an amino acid sequence of SEQ ID NO: 1526, 1479, 1527, 1480, 157, 1528, or 1481; and (3) a VL CDR3 having an amino acid sequence of SEQ ID NO: 1523, 1502, 1524, 1503, 1525, or 1504. In some aspects, the antibody comprises: (a) a VH region comprising: (1) a VH CDR1 having an amino acid sequence of SEQ ID NO: 1301, 1302, 1303, 1304, or 1305; (2) a VH CDR2 having an amino acid sequence of SEQ ID NO: 1364, 1365, 1361, 1366, or 1367; and (3) a VH CDR3 having an amino acid sequence of SEQ ID NO: 1401, 1402, 1403, or 1404; and (b) a VL region comprising: (1) a VL CDR1 having an amino acid sequence of SEQ ID NO: 1454, 1455, 1456, or 1457; (2) a VL CDR2 having an amino acid sequence of SEQ ID NO: 40, 1103, or 1114; and (3) a VL CDR3 having an amino acid sequence of SEQ ID NO: 1505, 1506, or 1507. In some aspects, the antibody comprises: (a) a VH region comprising: (1) a VH CDR1 having an amino acid sequence of SEQ ID NO: 1311, 1312, 1313, 1314, or 1315; (2) a VH CDR2 having an amino acid sequence of SEQ ID NO: 37, 1082, 1088, 1093, or 1098; and (3) a VH CDR3 having an amino acid sequence of SEQ ID NO: 1409, 1410, 1411, or 1412; and (b) a VL region comprising: (1) a VL CDR1 having an amino acid sequence of SEQ ID NO: 45, 1102, 1108, or 1113; (2) a VL CDR2 having an amino acid sequence of SEQ ID NO: 40, 1103, or 1114; and (3) a VL CDR3 having an amino acid sequence of SEQ ID NO: 1511, 1512, or 1513. In some aspects, the antibody comprises: (a) a VH region comprising: (1) a VH CDR1 having an amino acid sequence of SEQ ID NO: 1321, 1322, 1323, 1324, or 1325; (2) a VH CDR2 having an amino acid sequence of SEQ ID NO: 849, 1082, 1088, 1373, or 1374; and (3) a VH CDR3 having an amino acid sequence of SEQ ID NO: 38, 1083, 1089, or 1094; and (b) a VL region comprising: (1) a VL CDR1 having an amino acid sequence of SEQ ID NO: 45, 1102, 1108, or 1113; (2) a VL CDR2 having an amino acid sequence of SEQ ID NO: 40, 1103, or 1114; and (3) a VL CDR3 having an amino acid sequence of SEQ ID NO: 1514, 1515, or 1516.

In certain embodiments, the antibody provided herein binds a first group of C10orf54 proteins or chimeric proteins designated CC1 (SEQ ID NO: 1079), CC4 (SEQ ID NO: 1245), CC5 (SEQ ID NO: 1246), and CC8 (SEQ ID NO: 1249), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspected, such an antibody does not comprise one or more CDR sequences selected from the group consisting of 30, 1099, 1104, 1105, 1110, 31, 1100, 1106, 1111, 1116, 32, 1101, 1107, 1112, 45, 1102, 1108, 1113, 40, 1103, 1114, 41, 1109, and 1115. In some aspects, the antibody comprises: (a) a heavy chain variable (VH) region comprising: (1) a VH CDR1 having an amino acid sequence selected from the group consisting of SEQ ID NOS: 30, 1099, 1110, 1104, 1105, 1296-1300, 1306-1310, 1316-1320, and 1717-1720; (2) a VH CDR2 having an amino acid sequence selected from the group consisting of SEQ ID NOS: 31, 37, 1082, 1088, 1092, 1098, 1100, 1106, 1111, 1116, 1354-1358, 1368-1372, 1829-1847, and 1917; and (3) a VH CDR3 having an amino acid sequence selected from the group consisting of SEQ ID NOS: 32, 38, 1083, 1089, 1094, 1101, 1107, 1112, 1393-1396, 1405-1408, 1413, 1414; and/or (b) a light chain variable (VL) region comprising: (1) a VL CDR1 having an amino acid sequence selected from the group consisting of SEQ ID NOS: 45, 253-271, 1102, 1108, 1113, 1431-1434, 1458-1465, 1744-1822, 1878-1896; (2) a VL CDR2 having an amino acid sequence selected from the group consisting of SEQ ID NOS: 40, 843-846, 1103, 1114, 1476-1478, 1482-1487, 1898-1900; and (3) a VL CDR3 having an amino acid sequence selected from the group consisting of SEQ ID NOS: 41, 1109, 1115, 1499-1501, 1508-1513. In some aspects, the antibody comprises: (a) a VH region comprising: (1) a VH CDR1 having an amino acid sequence of SEQ ID NO: 1296, 1297, 1298, 1299, or 1300; (2) a VH CDR2 having an amino acid sequence of SEQ ID NO: 1354, 1355, 1356, 1357, or 1358; and (3) a VH CDR3 having an amino acid sequence of SEQ ID NO: 1393, 1394, 1395, or 1396; and (b) a VL region comprising: (1) a VL CDR1 having an amino acid sequence of SEQ ID NO: 1431, 1432, 1433, or 1434; (2) a VL CDR2 having an amino acid sequence of SEQ ID NO: 1476, 1477, or 1478; and (3) a VL CDR3 having an amino acid sequence of SEQ ID NO: 1499, 1500, or 1501. In some aspects, the antibody comprises: (a) a VH region comprising: (1) a VH CDR1 having an amino acid sequence of SEQ ID NO: 1306, 1307, 1308, 1309, or 1310; (2) a VH CDR2 having an amino acid sequence of SEQ ID NO: 1368, 1369, 1370, 1371, or 1372; and (3) a VH CDR3 having an amino acid sequence of SEQ ID NO: 1405, 1406, 1407, or 1408; and (b) a VL region comprising: (1) a VL CDR1 having an amino acid sequence of SEQ ID NO: 1458, 1459, 1460, or 1461; (2) a VL CDR2 having an amino acid sequence of SEQ ID NO: 1482, 1483, or 1484; and (3) a VL CDR3 having an amino acid sequence of SEQ ID NO: 1508, 1509, or 1510. In some aspects, the antibody comprises: (a) a VH region comprising: (1) a VH CDR1 having an amino acid sequence of SEQ ID NO: 1306, 1307, 1308, 1309, or 1310; (2) a VH CDR2 having an amino acid sequence of SEQ ID NO: 1368, 1369, 1370, 1371, 1372, 1829, 1830, 1831, 1832, 1833, 1834, 1835, 1836, 1837, 1838, 1839, 1840, 1841, 1842, 1843, 1844, 1845, 1846, or 1847; and (3) a VH CDR3 having an amino acid sequence of SEQ ID NO: 1405, 1406, 1407, or 1408; and (b) a VL region comprising: (1) a VL CDR1 having an amino acid sequence of SEQ ID NO: 1458, 1459, 1460, 1461, 1878, 1879, 1880, 1881, 1882, 1883, 1884, 1885, 1886, 1887, 1888, 1889, 1890, 1891, 1892, 1893, 1894, 1895, or 1896; (2) a VL CDR2 having an amino acid sequence of SEQ ID NO: 1485, 1486, 1487, 1897, 1898, 1899, or 1900; and (3) a VL CDR3 having an amino acid sequence of SEQ ID NO: 1508, 1509, or 1510. In some aspects, the antibody comprises: (a) a VH region comprising: (1) a VH CDR1 having an amino acid sequence of SEQ ID NO: 1316, 1317, 1318, 1319, or 1320; (2) a VH CDR2 having an amino acid sequence of SEQ ID NO: 37, 1082, 1088, 1092, or 1098; and (3) a VH CDR3 having an amino acid sequence of SEQ ID NO: 38, 1083, 1089, or 1094; and (b) a VL region comprising: (1) a VL CDR1 having an amino acid sequence of SEQ ID NO: 1462, 1463, 1464, or 1465; (2) a VL CDR2 having an amino acid sequence of SEQ ID NO: 40, 1103, or 1114; and (3) a VL CDR3 having an amino acid sequence of SEQ ID NO: 1511, 1512, or 1513. In some aspects, the antibody comprises: (a) a VH region comprising: (1) a VH CDR1 having an amino acid sequence of SEQ ID NO: 1316, 1317, 1318, 1319, 1320, 1717, 1718, 1719, or 1720; (2) a VH CDR2 having an amino acid sequence of SEQ ID NO: 37, 1082, 1088, 1917, or 1098; and (3) a VH CDR3 having an amino acid sequence of SEQ ID NO: 1413, 1414, 1089, or 1094; and (b) a VL region comprising: (1) a VL CDR1 having an amino acid sequence of SEQ ID NO: 1462, 1463, 1464, 1465, 1744, 45, 1745, 1746, 1747, 1748, 1749, 1750, 1751, 1752, 1753, 1754, 1755, 1756, 1757, 1758, 1759, 1760, 253, 254, 255, 256, 257, 258, 259, 1761, 1762, 1763, 1764, 1765, 1766, 1767, 1768, 1769, 1770, 1771, 1772, 1773, 1774, 1775, 1776, 1777, 1778, 1779, 1780, 1781, 1782, 1783, 1784, 1785, 1786, 1787, 260, 1788, 1789, 1790, 1791, 264, 268, 1792, 1793, 1794, 1795, 1796, 261, 1797, 1798, 1799, 1800, 265, 269, 1801, 1802, 1803, 1804, 1805, 262, 1806, 1807, 1808, 1809, 266, 270, 1810, 1811, 1812, 1813, 1814, 263, 1815, 1816, 1817, 1818, 267, 271, 1819, 1820, 1821, or 1822; (2) a VL CDR2 having an amino acid sequence of SEQ ID NO: 40, 1103, 1114, 843, 844, 846, or 845; and (3) a VL CDR3 having an amino acid sequence of SEQ ID NO: 1511, 1512, or 1513.

In certain embodiments, the antibody provided herein binds to a first group of C10orf54 proteins or chimeric proteins designated CC1 (SEQ ID NO: 1079), CC4 (SEQ ID NO: 1245), and CC5 (SEQ ID NO: 1246), and does not bind to a second grouped of C10orf54 proteins or chimeric proteins designated (SEQ ID NO: 1243), CC3 (SEQ ID NO: 1244), CC6 (SEQ ID NO: 1247), CC7 (SEQ ID NO: 1248), CC8 (SEQ ID NO: 1249), CC9 (SEQ ID NO: 1250), and CC10 (SEQ ID NO: 1251). In some aspects, such an antibody does not comprise one or more CDR sequences selected from the group consisting of 36, 1081, 1086, 1087, 1092, 37, 1082, 1088, 1093, 1098, 38, 1083, 1089, 1094, 45, 1084, 1090, 1095, 46, 1085, 1096, 47, 1091, and 1097.

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC9 (SEQ ID NO: 1250), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspects, such an antibody does not comprise one or more CDR sequences selected from the group consisting of 33, 1117, 1122, 1123, 1128, 34, 1118, 1124, 1129, 1134, 35, 1119, 1125, 1130, 42, 1120, 1126, 1131, 43, 1121, 1132, 44, 1127, and 1133. In some aspects, the antibody comprises: (a) a heavy chain variable (VH) region comprising: (1) a VH CDR1 having an amino acid sequence selected from the group consisting of SEQ ID NOS: 33, 1117, 1122, 1123, and 1128; (2) a VH CDR2 having an amino acid sequence selected from the group consisting of SEQ ID NOS: 34, 1082, 1088, 1118, 1124, 1129, and 1134; and (3) a VH CDR3 having an amino acid sequence selected from the group consisting of SEQ ID NOS: 35, 1119, 1125, 1130, 1415, and 1416; and/or (b) a light chain variable (VL) region comprising: (1) a VL CDR1 having an amino acid sequence selected from the group consisting of SEQ ID NOS: 42, 1120, 1126, and 1131; (2) a VL CDR2 having an amino acid sequence selected from the group consisting of SEQ ID NOS: 43, 1121, and 1132; and (3) a VL CDR3 having an amino acid sequence selected from the group consisting of SEQ ID NOS: 44, 1127, and 1133. In some aspects, the antibody comprises: (a) a VH region comprising: (1) a VH CDR1 having an amino acid sequence of SEQ ID NO: 33, 1117, 1122, 1123, or 1128; (2) a VH CDR2 having an amino acid sequence of SEQ ID NO: 34, 1082, 1088, 1129, or 1134; and (3) a VH CDR3 having an amino acid sequence of SEQ ID NO: 35, 1415, 1125, or 1416; and/or (b) a VL region comprising: (1) a VL CDR1 having an amino acid sequence of SEQ ID NO: 42, 1120, 1126, or 1131; (2) a VL CDR2 having an amino acid sequence of SEQ ID NO: 43, 1121, or 1132; and (3) a VL CDR3 having an amino acid sequence of SEQ ID NO: 44, 1127, or 1133.

In certain embodiments, the antibody provided herein binds to a first group of C10orf54 proteins or chimeric proteins designated CC1 (SEQ ID NO: 1079), CC3 (SEQ ID NO: 1244), CC4 (SEQ ID NO: 1245), CC5 (SEQ ID NO: 1246), CC8 (SEQ ID NO: 1249), and CC9 (SEQ ID NO: 1250), and does not bind to a second grouped of C10orf54 proteins or chimeric proteins designated CC2 (SEQ ID NO: 1243), CC6 (SEQ ID NO: 1247), CC7 (SEQ ID NO: 1248), and CC10 (SEQ ID NO: 1251). In some aspects, the antibody comprises: (a) a VH region comprising: (1) a VH CDR1 having an amino acid sequence of SEQ ID NO: 1326, 1327, 1328, 1329, or 1330; (2) a VH CDR2 having an amino acid sequence of SEQ ID NO: 1375, 1376, 1377, 1378, or 1379; and (3) a VH CDR3 having an amino acid sequence of SEQ ID NO: 1417, 1418, 1419, or 1420; and/or (b) a VL region comprising: (1) a VL CDR1 having an amino acid sequence of SEQ ID NO: 1466, 1467, or 1468; (2) a VL CDR2 having an amino acid sequence of SEQ ID NO: 1488, 1489, or 1490; and (3) a VL CDR3 having an amino acid sequence of SEQ ID NO: 1517, 1518, or 1519.

In certain embodiments, the antibody provided herein binds to a first group of C10orf54 proteins or chimeric proteins designated CC1 (SEQ ID NO: 1079), CC4 (SEQ ID NO: 1245), CC5 (SEQ ID NO: 1246), CC8 (SEQ ID NO: 1249), and CC10 (SEQ ID NO: 1251), and does not bind to a second grouped of C10orf54 proteins or chimeric proteins designated CC2 (SEQ ID NO: 1243), CC3 (SEQ ID NO: 1244), CC6 (SEQ ID NO: 1247), CC7 (SEQ ID NO: 1248), CC9 (SEQ ID NO: 1250), and CC10 (SEQ ID NO: 1251). In some aspects, the antibody comprises: (a) a VH region comprising: (1) a VH CDR1 having an amino acid sequence of SEQ ID NO: 1331, 1332, 1333, 1334, or 1335; (2) a VH CDR2 having an amino acid sequence of SEQ ID NO: 1380, 1381, 1382, 1383, or 1384; and (3) a VH CDR3 having an amino acid sequence of SEQ ID NO: 1421, 1422, 1423, or 1424; and/or (b) a VL region comprising: (1) a VL CDR1 having an amino acid sequence of SEQ ID NO: 1469, 1470, 1471, or 1472; (2) a VL CDR2 having an amino acid sequence of SEQ ID NO: 1491, 1488, or 1492; and (3) a VL CDR3 having an amino acid sequence of SEQ ID NO: 1520, 1521, or 1522.

In accordance with the amino acid sequences disclosed in Tables 12-33, in some embodiments, an antibody that binds to a C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 36, 1081, 1086, 1087, 1092, 30, 1099, 1104, 1105, 1110, 33, 1117, 1122, 1123, 1128 or 1291-1335; (2) a VH CDR2 having an amino acid sequence of SEQ ID NO: 37, 1082, 1088, 1093, 1098, 31, 1100, 1106, 1111, 1116, 34, 1118, 1124, 1129, 1134 or 1336-1384; and/or (3) a VH CDR3 having an amino acid sequence of SEQ ID NO: 38, 1083, 1089, 1094, 32, 1101, 1107, 1112, 35, 1119, 1125, 1130 or 1385-1424. In certain embodiments, an antibody that binds to C10orf54 (e.g., C10orf54 polypeptide, C10orf54 polypeptide fragment, C10orf54 epitope) comprises a VL region comprising: (1) a VL CDR1 having an amino acid sequence of SEQ ID NO: 45, 1084, 1090, 1095, 1102, 1108, 1113, 42, 1120, 1126, 1131 or 1425-1472; (2) a VL CDR2 having an amino acid sequence of SEQ ID NO: 46, 1085, 1096, 40, 1103, 1114, 43, 1121 and 1132; and/or (3) a VL CDR3 having an amino acid sequence of SEQ ID NO: 47, 1091, 1097, 41, 1109, 1115, 44, 1127, 1133 or 1493-1525. In some embodiments, the antibody comprises: (a) a VH region comprising: (1) a VH CDR1 having an amino acid sequence of SEQ ID NO: 36, 1081, 1086, 1087, 1092, 30, 1099, 1104, 1105, 1110, 33, 1117, 1122, 1123, 1128 or 1291-1335; (2) a VH CDR2 having an amino acid sequence of SEQ ID NO: 37, 1082, 1088, 1093, 1098, 31, 1100, 1106, 1111, 1116, 34, 1118, 1124, 1129, 1134 or 1336-1384; and/or (3) a VH CDR3 having an amino acid sequence of SEQ ID NO: 38, 1083, 1089, 1094, 32, 1101, 1107, 1112, 35, 1119, 1125, 1130 or 1385-1424; and (b) a VL region comprising: (1) a VL CDR1 having an amino acid sequence of SEQ ID NO: 45, 1084, 1090, 1095, 1102, 1108, 1113, 42, 1120, 1126, 1131 or 1425-1472; (2) a VL CDR2 having an amino acid sequence of SEQ ID NO: 46, 1085, 1096, 40, 1103, 1114, 43, 1121, 1132, 1473-1492 or 1526-1528; and/or (3) a VL CDR3 having an amino acid sequence of SEQ ID NO: 47, 1091, 1097, 41, 1109, 1115, 44, 1127, 1133 or 1493-1525.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1081; (2) a VH CDR2 having an amino acid sequence of SEQ ID NO: 1082; and (3) a VH CDR3 having an amino acid sequence of SEQ ID NO: 1083. In some embodiments, the antibody further comprises a VL region comprising: (1) a VL CDR1 having an amino acid sequence of SEQ ID NO: 1084; (2) a VL CDR2 having an amino acid sequence of SEQ ID NO: 1085; and (3) a VL CDR3 having an amino acid sequence of SEQ ID NO: 47. In one embodiment, the antibody comprises: (a) a VH region comprising: (1) a VH CDR1 having an amino acid sequence of SEQ ID NO: 1081; (2) a VH CDR2 having an amino acid sequence of SEQ ID NO: 1082; and (3) a VH CDR3 having an amino acid sequence of SEQ ID NO: 1083; and (b) a VL region comprising: (1) a VL CDR1 having an amino acid sequence of SEQ ID NO: 1084; (2) a VL CDR2 having an amino acid sequence of SEQ ID NO: 1085; and (3) a VL CDR3 having an amino acid sequence of SEQ ID NO: 47.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1086; (2) a VH CDR2 having an amino acid sequence of SEQ ID NO: 37; and (3) a VH CDR3 having an amino acid sequence of SEQ ID NO: 38. In some embodiments, the antibody further comprises a VL region comprising: (1) a VL CDR1 having an amino acid sequence of SEQ ID NO: 45; (2) a VL CDR2 having an amino acid sequence of SEQ ID NO: 46; and (3) a VL CDR3 having an amino acid sequence of SEQ ID NO: 47. In one embodiment, the antibody comprises: (a) a VH region comprising: (1) a VH CDR1 having an amino acid sequence of SEQ ID NO: 1086; (2) a VH CDR2 having an amino acid sequence of SEQ ID NO: 37; and (3) a VH CDR3 having an amino acid sequence of SEQ ID NO: 38; and (b) a VL region comprising: (1) a VL CDR1 having an amino acid sequence of SEQ ID NO: 45; (2) a VL CDR2 having an amino acid sequence of SEQ ID NO: 46; and (3) a VL CDR3 having an amino acid sequence of SEQ ID NO: 47.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1087; (2) a VH CDR2 having an amino acid sequence of SEQ ID NO: 1088; and (3) a VH CDR3 having an amino acid sequence of SEQ ID NO: 1089. In some embodiments, the antibody further comprises a VL region comprising: (1) a VL CDR1 having an amino acid sequence of SEQ ID NO: 1090; (2) a VL CDR2 having an amino acid sequence of SEQ ID NO: 1085; and (3) a VL CDR3 having an amino acid sequence of SEQ ID NO: 1091. In one embodiment, the antibody comprises: (a) a VH region comprising: (1) a VH CDR1 having an amino acid sequence of SEQ ID NO: 1087; (2) a VH CDR2 having an amino acid sequence of SEQ ID NO: 1088; and (3) a VH CDR3 having an amino acid sequence of SEQ ID NO: 1089; and (b) a VL region comprising: (1) a VL CDR1 having an amino acid sequence of SEQ ID NO: 1090; (2) a VL CDR2 having an amino acid sequence of SEQ ID NO: 1085; and (3) a VL CDR3 having an amino acid sequence of SEQ ID NO: 1091.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1092; (2) a VH CDR2 having an amino acid sequence of SEQ ID NO: 1093; and (3) a VH CDR3 having an amino acid sequence of SEQ ID NO: 1094. In some embodiments, the antibody further comprises a VL region comprising: (1) a VL CDR1 having an amino acid sequence of SEQ ID NO: 1095; (2) a VL CDR2 having an amino acid sequence of SEQ ID NO: 1096; and (3) a VL CDR3 having an amino acid sequence of SEQ ID NO: 1097. In one embodiment, the antibody comprises: (a) a VH region comprising: (1) a VH CDR1 having an amino acid sequence of SEQ ID NO: 1092; (2) a VH CDR2 having an amino acid sequence of SEQ ID NO: 1093; and (3) a VH CDR3 having an amino acid sequence of SEQ ID NO: 1094; and (b) a VL region comprising: (1) a VL CDR1 having an amino acid sequence of SEQ ID NO: 1095; (2) a VL CDR2 having an amino acid sequence of SEQ ID NO: 1096; and (3) a VL CDR3 having an amino acid sequence of SEQ ID NO: 1097.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 36; (2) a VH CDR2 having an amino acid sequence of SEQ ID NO: 1098; and (3) a VH CDR3 having an amino acid sequence of SEQ ID NO: 38. In some embodiments, the antibody further comprises a VL region comprising: (1) a VL CDR1 having an amino acid sequence of SEQ ID NO: 45; (2) a VL CDR2 having an amino acid sequence of SEQ ID NO: 46; and (3) a VL CDR3 having an amino acid sequence of SEQ ID NO: 47. In one embodiment, the antibody comprises: (a) a VH region comprising: (1) a VH CDR1 having an amino acid sequence of SEQ ID NO: 36; (2) a VH CDR2 having an amino acid sequence of SEQ ID NO: 1098; and (3) a VH CDR3 having an amino acid sequence of SEQ ID NO: 38; and (b) a VL region comprising: (1) a VL CDR1 having an amino acid sequence of SEQ ID NO: 45; (2) a VL CDR2 having an amino acid sequence of SEQ ID NO: 46; and (3) a VL CDR3 having an amino acid sequence of SEQ ID NO: 47.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1099; (2) a VH CDR2 having an amino acid sequence of SEQ ID NO: 1100; and (3) a VH CDR3 having an amino acid sequence of SEQ ID NO: 1101. In some embodiments, the antibody further comprises a VL region comprising: (1) a VL CDR1 having an amino acid sequence of SEQ ID NO: 1102; (2) a VL CDR2 having an amino acid sequence of SEQ ID NO: 1103; and (3) a VL CDR3 having an amino acid sequence of SEQ ID NO: 41. In one embodiment, the antibody comprises: (a) a VH region comprising: (1) a VH CDR1 having an amino acid sequence of SEQ ID NO: 1099; (2) a VH CDR2 having an amino acid sequence of SEQ ID NO: 1100; and (3) a VH CDR3 having an amino acid sequence of SEQ ID NO: 1101; and (b) a VL region comprising: (1) a VL CDR1 having an amino acid sequence of SEQ ID NO: 1102; (2) a VL CDR2 having an amino acid sequence of SEQ ID NO: 1103; and (3) a VL CDR3 having an amino acid sequence of SEQ ID NO: 41.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1104; (2) a VH CDR2 having an amino acid sequence of SEQ ID NO: 31; and (3) a VH CDR3 having an amino acid sequence of SEQ ID NO: 32. In some embodiments, the antibody further comprises a VL region comprising: (1) a VL CDR1 having an amino acid sequence of SEQ ID NO: 45; (2) a VL CDR2 having an amino acid sequence of SEQ ID NO: 40; and (3) a VL CDR3 having an amino acid sequence of SEQ ID NO: 41. In one embodiment, the antibody comprises: (a) a VH region comprising: (1) a VH CDR1 having an amino acid sequence of SEQ ID NO: 1104; (2) a VH CDR2 having an amino acid sequence of SEQ ID NO: 31; and (3) a VH CDR3 having an amino acid sequence of SEQ ID NO: 32; and (b) a VL region comprising: (1) a VL CDR1 having an amino acid sequence of SEQ ID NO: 45; (2) a VL CDR2 having an amino acid sequence of SEQ ID NO: 40; and (3) a VL CDR3 having an amino acid sequence of SEQ ID NO: 41.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1105; (2) a VH CDR2 having an amino acid sequence of SEQ ID NO: 1106; and (3) a VH CDR3 having an amino acid sequence of SEQ ID NO: 1107. In some embodiments, the antibody further comprises a VL region comprising: (1) a VL CDR1 having an amino acid sequence of SEQ ID NO: 1108; (2) a VL CDR2 having an amino acid sequence of SEQ ID NO: 1103; and (3) a VL CDR3 having an amino acid sequence of SEQ ID NO: 1109. In one embodiment, the antibody comprises: (a) a VH region comprising: (1) a VH CDR1 having an amino acid sequence of SEQ ID NO: 1105; (2) a VH CDR2 having an amino acid sequence of SEQ ID NO: 1106; and (3) a VH CDR3 having an amino acid sequence of SEQ ID NO: 1107; and (b) a VL region comprising: (1) a VL CDR1 having an amino acid sequence of SEQ ID NO: 1108; (2) a VL CDR2 having an amino acid sequence of SEQ ID NO: 1103; and (3) a VL CDR3 having an amino acid sequence of SEQ ID NO: 1109.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1110; (2) a VH CDR2 having an amino acid sequence of SEQ ID NO: 1111; and (3) a VH CDR3 having an amino acid sequence of SEQ ID NO: 1112. In some embodiments, the antibody further comprises a VL region comprising: (1) a VL CDR1 having an amino acid sequence of SEQ ID NO: 1113; (2) a VL CDR2 having an amino acid sequence of SEQ ID NO: 1114; and (3) a VL CDR3 having an amino acid sequence of SEQ ID NO: 1115. In one embodiment, the antibody comprises: (a) a VH region comprising: (1) a VH CDR1 having an amino acid sequence of SEQ ID NO: 1110; (2) a VH CDR2 having an amino acid sequence of SEQ ID NO: 1111; and (3) a VH CDR3 having an amino acid sequence of SEQ ID NO: 1112; and (b) a VL region comprising: (1) a VL CDR1 having an amino acid sequence of SEQ ID NO: 1113; (2) a VL CDR2 having an amino acid sequence of SEQ ID NO: 1114; and (3) a VL CDR3 having an amino acid sequence of SEQ ID NO: 1115.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 30; (2) a VH CDR2 having an amino acid sequence of SEQ ID NO: 1116; and (3) a VH CDR3 having an amino acid sequence of SEQ ID NO: 32. In some embodiments, the antibody further comprises a VL region comprising: (1) a VL CDR1 having an amino acid sequence of SEQ ID NO: 45; (2) a VL CDR2 having an amino acid sequence of SEQ ID NO: 40; and (3) a VL CDR3 having an amino acid sequence of SEQ ID NO: 41. In one embodiment, the antibody comprises: (a) a VH region comprising: (1) a VH CDR1 having an amino acid sequence of SEQ ID NO: 30; (2) a VH CDR2 having an amino acid sequence of SEQ ID NO: 1116; and (3) a VH CDR3 having an amino acid sequence of SEQ ID NO: 32; and (b) a VL region comprising: (1) a VL CDR1 having an amino acid sequence of SEQ ID NO: 45; (2) a VL CDR2 having an amino acid sequence of SEQ ID NO: 40; and (3) a VL CDR3 having an amino acid sequence of SEQ ID NO: 41.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1117; (2) a VH CDR2 having an amino acid sequence of SEQ ID NO: 1118; and (3) a VH CDR3 having an amino acid sequence of SEQ ID NO: 1119. In some embodiments, the antibody further comprises a VL region comprising: (1) a VL CDR1 having an amino acid sequence of SEQ ID NO: 1120; (2) a VL CDR2 having an amino acid sequence of SEQ ID NO: 1121; and (3) a VL CDR3 having an amino acid sequence of SEQ ID NO: 44. In one embodiment, the antibody comprises: (a) a VH region comprising: (1) a VH CDR1 having an amino acid sequence of SEQ ID NO: 1117; (2) a VH CDR2 having an amino acid sequence of SEQ ID NO: 1118; and (3) a VH CDR3 having an amino acid sequence of SEQ ID NO: 1119; and (b) a VL region comprising: (1) a VL CDR1 having an amino acid sequence of SEQ ID NO: 1120; (2) a VL CDR2 having an amino acid sequence of SEQ ID NO: 1121; and (3) a VL CDR3 having an amino acid sequence of SEQ ID NO: 44.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1122; (2) a VH CDR2 having an amino acid sequence of SEQ ID NO: 34; and (3) a VH CDR3 having an amino acid sequence of SEQ ID NO: 35. In some embodiments, the antibody further comprises a VL region comprising: (1) a VL CDR1 having an amino acid sequence of SEQ ID NO: 42; (2) a VL CDR2 having an amino acid sequence of SEQ ID NO: 43; and (3) a VL CDR3 having an amino acid sequence of SEQ ID NO: 44. In one embodiment, the antibody comprises: (a) a VH region comprising: (1) a VH CDR1 having an amino acid sequence of SEQ ID NO: 1122; (2) a VH CDR2 having an amino acid sequence of SEQ ID NO: 34; and (3) a VH CDR3 having an amino acid sequence of SEQ ID NO: 35; and (b) a VL region comprising: (1) a VL CDR1 having an amino acid sequence of SEQ ID NO: 42; (2) a VL CDR2 having an amino acid sequence of SEQ ID NO: 43; and (3) a VL CDR3 having an amino acid sequence of SEQ ID NO: 44.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1123; (2) a VH CDR2 having an amino acid sequence of SEQ ID NO: 1124; and (3) a VH CDR3 having an amino acid sequence of SEQ ID NO: 1125. In some embodiments, the antibody further comprises a VL region comprising: (1) a VL CDR1 having an amino acid sequence of SEQ ID NO: 1126; (2) a VL CDR2 having an amino acid sequence of SEQ ID NO: 1121; and (3) a VL CDR3 having an amino acid sequence of SEQ ID NO: 1127. In one embodiment, the antibody comprises: (a) a VH region comprising: (1) a VH CDR1 having an amino acid sequence of SEQ ID NO: 1123; (2) a VH CDR2 having an amino acid sequence of SEQ ID NO: 1124; and (3) a VH CDR3 having an amino acid sequence of SEQ ID NO: 1125; and (b) a VL region comprising: (1) a VL CDR1 having an amino acid sequence of SEQ ID NO: 1126; (2) a VL CDR2 having an amino acid sequence of SEQ ID NO: 1121; and (3) a VL CDR3 having an amino acid sequence of SEQ ID NO: 1127.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 1128; (2) a VH CDR2 having an amino acid sequence of SEQ ID NO: 1129; and (3) a VH CDR3 having an amino acid sequence of SEQ ID NO: 1130. In some embodiments, the antibody further comprises a VL region comprising: (1) a VL CDR1 having an amino acid sequence of SEQ ID NO: 1131; (2) a VL CDR2 having an amino acid sequence of SEQ ID NO: 1132; and (3) a VL CDR3 having an amino acid sequence of SEQ ID NO: 1133. In one embodiment, the antibody comprises: (a) a VH region comprising: (1) a VH CDR1 having an amino acid sequence of SEQ ID NO: 1128; (2) a VH CDR2 having an amino acid sequence of SEQ ID NO: 1129; and (3) a VH CDR3 having an amino acid sequence of SEQ ID NO: 1130; and (b) a VL region comprising: (1) a VL CDR1 having an amino acid sequence of SEQ ID NO: 1131; (2) a VL CDR2 having an amino acid sequence of SEQ ID NO: 1132; and (3) a VL CDR3 having an amino acid sequence of SEQ ID NO: 1133.

In one embodiment, an antibody that binds to C10orf54 (e.g., C10orf54 polypeptide, C10orf54 polypeptide fragment, C10orf54 epitope) comprises a VH region comprising: (1) a VH CDR1 having an amino acid sequence of SEQ ID NO: 33; (2) a VH CDR2 having an amino acid sequence of SEQ ID NO: 1134; and (3) a VH CDR3 having an amino acid sequence of SEQ ID NO: 35. In some embodiments, the antibody further comprises a VL region comprising: (1) a VL CDR1 having an amino acid sequence of SEQ ID NO: 42; (2) a VL CDR2 having an amino acid sequence of SEQ ID NO: 43; and (3) a VL CDR3 having an amino acid sequence of SEQ ID NO: 44. In one embodiment, the antibody comprises: (a) a VH region comprising: (1) a VH CDR1 having an amino acid sequence of SEQ ID NO: 33; (2) a VH CDR2 having an amino acid sequence of SEQ ID NO: 1134; and (3) a VH CDR3 having an amino acid sequence of SEQ ID NO: 35; and (b) a VL region comprising: (1) a VL CDR1 having an amino acid sequence of SEQ ID NO: 42; (2) a VL CDR2 having an amino acid sequence of SEQ ID NO: 43; and (3) a VL CDR3 having an amino acid sequence of SEQ ID NO: 44.

In certain embodiments, a humanized anti-C10orf54 antibody that binds to C10orf54 (e.g., C10orf54 polypeptide, C10orf54 polypeptide fragment, C10orf54 epitope) comprises one or more consensus sequences derived from related antibodies as depicted in FIGS. 17A and 17B. As described herein, a "consensus sequence" refers to amino acid sequences having conserved amino acids common among a number of sequences and variable amino acids that vary within a given amino acid sequences. The CDR consensus sequences provided include CDRs corresponding to CDRH1, CDRH2, CDRH3, CDRL1, CDRL2 and/or CDRL3. Consensus sequences of CDRs of anti-C10orf54 antibodies are shown in FIGS. 17A and 17B. Accordingly, in some embodiments, a humanized anti-C10orf54 antibody comprises a VH region comprising: (1) a VH CDR1 having an amino acid sequence of GYTFSX$_1$X$_2$WIE (SEQ ID NO: 1149), wherein X$_1$ is a R or T and X$_2$ is a Y or H; (2) a VH CDR2 having an amino acid sequence of EILPGSGSTX$_1$YNEKFKG (SEQ ID NO: 1150), wherein X$_1$ is a N or S; and/or (3) a VH CDR3 having an amino acid sequence of xxxxxxxxxX$_1$X$_2$Y (SEQ ID NO: 1151), wherein x is any amino acid residue, X$_1$ is a M or F, and X$_2$ is G or D. In certain embodiments, a humanized anti-C10orf54 antibody comprises a VL region comprising: (1) a VL CDR1 having an amino acid sequence of RSSQSIVHSNGNTYLE (SEQ ID NO: 45); (2) a VL CDR2 having an amino acid sequence of KX$_1$SNRFS (SEQ ID NO: 1152), wherein X$_1$ is a V or L; and/or (3) a VL CDR3 having an amino acid sequence of FQGSHX$_1$PX$_2$T (SEQ ID NO: 1153), wherein X$_1$ is V or F and X$_2$ is a W or Y. In certain embodiments, a humanized anti-C10orf54 antibody comprises: (a) a VH region comprising: (1) a VH CDR1 having an amino acid sequence of GYTFSX$_1$X$_2$WIE (SEQ ID NO: 1149), wherein X$_1$ is a R or T and X$_2$ is a Y or H; (2) a VH CDR2 having an amino acid sequence of EILPGSGSTX$_1$YNEKFKG (SEQ ID NO: 1150), wherein X$_1$ is a N or S; and/or (3) a VH CDR3 having an amino acid sequence of xxxxxxxxxX$_1$X$_2$Y (SEQ ID NO: 1151), wherein x is any amino acid residue, X$_1$ is a M or F, and X$_2$ is G or D; and (b) a VL region comprising: (1) a VL CDR1 having an amino acid sequence of RSSQSIVHSNGNTYLE (SEQ ID NO: 45); (2) a VL CDR2 having an amino acid sequence of KX$_1$SNRFS (SEQ ID NO: 1152), wherein X$_1$ is a V or L; and/or (3) a VL CDR3 having an amino acid sequence of FQGSHX$_1$PX$_2$T (SEQ ID NO: 1153), wherein X$_1$ is V or F and X$_2$ is a W or Y.

In some embodiments, the antibodies provided herein comprise a VH region that comprises or consists of a VH domain. In other embodiments, the antibodies provided herein comprise a VH region that comprises or consists of a VH chain. In some embodiments, the antibodies provided herein comprise a VL region that comprises or consists of a VL domain. In other embodiments, the antibodies provided herein comprise a VL region that comprises or consists of a VL chain. In some embodiments, the antibodies provided herein have a combination of (i) a VH domain or VH chain; and/or (ii) a VL domain or VL chain.

In some embodiments, an antibody provided herein comprises or consists six CDRs, for example, VH CDR1, VH CDR2, VH CDR3, VL CDR1, VL CDR2, and/or VL CDR3 identified in Tables 5-33. In certain embodiments, an antibody provided herein can comprise less than six CDRs. In some embodiments, the antibody comprises or consists of one, two, three, four, or five CDRs selected from the group consisting of VH CDR1, VH CDR2, VH CDR3, VL CDR1, VL CDR2, and/or VL CDR3. In specific embodiments, the antibody comprises or consists of one, two, three, four, or five CDRs selected from the group consisting of VH CDR1, VH CDR2, VH CDR3, VL CDR1, VL CDR2, and/or VL CDR3 of the murine monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A described herein, or a humanized variant thereof, as identified in Tables 5-33. Accordingly, in some embodiments, the antibody comprises or consists of one, two, three four or five CDRs of anyone of the VH CDR1, VH CDR2, VH CDR3, VL CDR1, VL CDR2, and/or VL CDR3 identified in Tables 5-33.

In some embodiments, the antibodies provided herein comprise one or more (e.g. one, two or three) VH CDRs listed in Tables 5-33. In other embodiments, the antibodies provided herein comprise one or more (e.g., one, two or three) VL CDRs listed in Tables 5-33. In yet other embodiments, the antibodies provided herein comprise one or more (e.g., one, two or three) VH CDRs listed in Tables 5-33 and one or more VL CDRs listed in Tables 5-33. Accordingly, in certain embodiments, the antibodies comprise a VH CDR1 having the amino acid sequence of any one of SEQ ID NOS:36, 30, 59-62, 33, 1081, 1086, 1087, 1092, 1099, 1104, 1105, 1110, 1117, 1122, 1123, 1128, 1291-1335, 1291-1335, and 1717-1720. In another embodiment, the antibodies comprise a VH CDR2 having the amino acid sequence of any one of SEQ ID NOS: 37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847, and 1917. In another embodiment, the antibodies comprise a VH CDR3 having the amino acid sequence of any one of SEQ ID NOS: 38, 32, 319, 35, 883-885, 1083, 1089, 1094, 1101, 1107, 1112, 1119, 1125, 1130 and 1385-1424. In certain embodiments, the antibodies comprise a VH CDR1 and/or a VH CDR2 and/or a VH CDR3 independently selected from a VH CDR1, VH CDR2, VH CDR3 as depicted in any one of the VH regions depicted in Table 5-33. In certain embodiments, the antibodies comprise a VL CDR1 having the amino acid sequence of any one of SEQ ID NOS: 45, 253-271, 42, 1084, 1090, 1095, 1102, 1108, 1113, 1120, 1126, 1131, 1425-1472, 1681-1684, 1744-1822, 1878-1896, and 1915. In another embodiment, the antibodies comprise a VL CDR2 having the amino acid sequence of any one of SEQ ID NOS: 46, 272-275, 40, 843-846, 43, 1045-1048, 1085, 1096, 1103, 1114, 1121, 1132, 1473-1492, 1526-1528, 1630-1633, 1685-1688, and 1898-1900. In another embodiment, the antibodies comprise a VL CDR3 having the amino acid sequence of any one of SEQ ID NOS: 47, 41, 44, 1056-1058, 1091, 1097, 1109, 1115, 1127, 1133 and 1493-1525. In certain embodiments, the antibodies comprise a VL CDR1 and/or a VL CDR2 and/or a VL CDR3 independently selected from a VL CDR1, VL CDR2, VL CDR3 as depicted in any one of the VL regions depicted in Tables 5-33.

Also provided herein are antibodies comprising one or more VH CDRs and one or more (e.g., one, two or three) VL CDRs listed in Tables 5-33. In particular, provided herein is an antibody comprising a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720) and a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720) and a VL CDR2 (SEQ ID NOS: 46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720) and a VL CDR3 (SEQ ID NOS:47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917) and a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917) and a VL CDR3 (SEQ ID NOS:47, 41, 44, 1056-1058, 1091, 1097, 1109, 1115, 1127, 1133 or 1493-1525); a VH CDR3 (SEQ ID NOS:38, 32, 319, 35, 883-885, 1083, 1089, 1094, 1101, 1107, 1112, 1119, 1125, 1130 or 1385-1424) and a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915); a VH CDR3 (SEQ ID NOS:38, 32, 319, 35, 883-885, 1083, 1089, 1094, 1101, 1107, 1112, 1119, 1125, 1130 or 1385-1424) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR3 (SEQ ID NOS:38, 32, 319, 35, 883-885, 1083, 1089, 1094, 1101, 1107, 1112, 1119, 1125, 1130 or 1385-1424) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917) and a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917) and a VL CDR3 (SEQ ID NOS:47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424) and a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR3 (SEQ ID NOS:47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR3 (SEQ ID NOS:47, 41, 44, 1056-1058, 1091, 1097, 1109, 1115, 1127, 1133 or 1493-1525); a VH CDR3 (SEQ ID NOS:38, 32, 319, 35, 883-885, 1083, 1089, 1094, 1101, 1107, 1112, 1119, 1125, 1130 or 1385-1424), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424) and a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR3 (SEQ ID NOS:38, 32, 319, 35, 883-885, 1083, 1089, 1094, 1101, 1107, 1112, 1119, 1125, 1130 or 1385-1424), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915) and a VL CDR3 (SEQ ID NOS:47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-

1822, 1878-1896 or 1915) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900) and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900), and a VL CDR3 (SEQ ID NOS:47, 41, 44, 1056-1058, 1091, 1097, 1109, 1115, 1127, 1133 or 1493-1525); a VH CDR1 (SEQ ID NOS:36, 30, 59-62, 33, 1081, 1086, 1087, 1092, 1099, 1104, 1105, 1110, 1117, 1122, 1123, 1128, 1291-1335, 1291-1335 or 1717-1720), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900), and a VL CDR3 (SEQ ID NOS: 47, 41, 44, 1056-1058, 1091, 1097, 1109, 1115, 1127, 1133 or 1493-1525); a VH CDR2 (SEQ ID NOS:37, 101-104, 50, 114, 99, 100, 31, 65-74, 83-90, 95, 321, 322, 835-842, 34, 847-858, 49, 886-894, 1070-1078, 1082, 1088, 1093, 1098, 1100, 1106, 1111, 1116, 1118, 1124, 1129, 1134, 1336-1384, 1556-1559, 1829-1847 or 1917), a VH CDR3 (SEQ ID NOS:38, 32, 319, 35, 883-885, 1083, 1089, 1094, 1101, 1107, 1112, 1119, 1125, 1130 or 1385-1424), a VL CDR1 (SEQ ID NOS:45, 253-271, 42, 1084, 1090, 1095, 1102, 1108, 1113, 1120, 1126, 1131, 1425-1472, 1681-1684, 1744-1822, 1878-1896 or 1915), a VL CDR2 (SEQ ID NOS:46, 272-275, 40, 843-846, 43, 1045-1048, 1085, 1096, 1103, 1114, 1121, 1132, 1473-1492, 1526-1528, 1630-1633, 1685-1688 or 1898-1900), and a VL CDR3 (SEQ ID NOS:47, 41, 44, 1056-1058, 1091, 1097, 1109, 1115, 1127, 1133 or 1493-1525); or any combination thereof of the VH CDRs (SEQ ID NOS:36, 30, 59-62, 33, 37, 101-104, 50, 114, 99, 100, 31, 65-74, 83-90, 95, 321, 322, 835-842, 34, 847-858, 49, 886-894 1070-1078, 38, 32, 319, 35, 883-885, 1081, 1086, 1087, 1092, 1099, 1104, 1105, 1110, 1117, 1122, 1123, 1128, 1082, 1088, 1093, 1098, 1100, 1106, 1111, 1116, 1118, 1124, 1129, 1134, 1083, 1089, 1094, 1101, 1107, 1112, 1119, 1125 and 1130) and VL CDRs (SEQ ID NOS:45, 253-271, 42, 46, 272-275, 40, 843-846, 43, 1045-1048, 47, 41, 44, 1056-1058, 1084, 1090, 1095, 1102, 1108, 1113, 1120, 1126, 1131, 1085, 1096, 1103, 1114, 1121, 1132, 1091, 1097, 1109, 1115, 1127 and 1133) listed in Tables 5-33.

In certain embodiments, humanized anti-C10orf54 antibodies bind to a C10orf54 polypeptide, polypeptide fragment or epitope with an affinity comparable to that of one or more of the murine monoclonal antibodies designated 5B, 46A, 97A, 128A, 146C, 208A, 215A, 26A, 164A, 230A, 76E1, 53A, 259A, 33A, 39A, 124A, 175A, 321D, 141A, 51A, 353A, or 305A. The humanized anti-C10orf54 the antibodies can also comprise one, two, three or four human or humanized framework regions of the immunoglobulin heavy chain variable region and/or one, two, three or four human or humanized framework regions of the immunoglobulin light chain variable region. Also provided are heavy and/or light chain FR regions that contain one or more back-mutations in which a human FR residue is exchanged for the corresponding residue present in the parental murine heavy or light chain or another residue comparable residue. In some aspects, the amino acid sequences for CDR1, CDR2, and CDR3 of the heavy and light chains for some of the humanized anti-C10orf54 the antibodies can also include one or more mutations in which a CDR residue as identified in Tables 5-33. The amino acid sequences for FR1, FR2, FR3 and FR4 of the heavy and light chains that can be used for the humanized anti-C10orf54 the antibodies are identified in Tables 5-11 and FIGS. 3-9, 17 and 22-25.

In certain embodiments, a humanized antibody that binds to C10orf54 (e.g., C10orf54 polypeptide, C10orf54 polypeptide fragment, C10orf54 epitope) comprises a VH region that comprises: (1) a VH FR1 having an amino acid sequence selected from the group consisting of SEQ ID NOS:51, 105, 55, 115-121, 39, 58, 895-902, 1550-1555, 1649-1652, 1715, 1716, 1827, and 1828; (2) a VH FR2 having an amino acid sequence selected from the group consisting of SEQ ID NOS:52, 106, 56, 122-124, 63, 64, and 323-326; (3) a VH FR3 having an amino acid sequence selected from the group consisting of SEQ ID NOS:53, 107-113, 57, 125-251, 96-98, 292-318, 327-833, 53, 859-882, 903-1030, 1560-1614, 1653-1679, 1721-1742, and 1848-1875; and/or (4) a VH FR4 having an amino acid sequence of SEQ ID NO:54, 320, 168054, 320, 1680. Accordingly, in some embodiments, the humanized antibody comprises a VH region that includes a VH FR1 having an amino acid sequence selected from the group consisting of SEQ ID NOS:51, 105, 55, 115-121, 39, 58, 895-902, 1550-1555, 1649-1652, 1715, 1716, 1827, and 1828. In some embodiments, the humanized antibody comprises a VH region that includes a VH FR2 having an amino acid sequence selected from the group consisting of SEQ ID NOS:52, 106, 56, 122-124, 63, 64, and 323-326. In some embodiments, the humanized antibody comprises a VH region that includes a VH FR3 having an amino acid sequence selected from the group consisting of SEQ ID NOS:53, 107-113, 57, 125-251, 96-98, 292-318, 327-833, 53, 859-882, 903-1030, 1560-1614, 1653-1679, 1721-1742, and 1848-1875. In some embodiments, the humanized antibody comprises a VH region that includes a VH FR4 having an amino acid sequence of SEQ ID NO:54, 320, 168054, 320, 1680.

In certain embodiments, a humanized antibody that binds to C10orf54 (e.g., C10orf54 polypeptide, C10orf54 polypeptide fragment, C10orf54 epitope) comprises a VL region that comprises: (1) a VL FR1 having an amino acid sequence selected from the group consisting of SEQ ID NOS:75, 252, 79, 277-283, 91, 1031-1037, 1059-1061, 1615-1629, 1743, 1877, and 1878; (2) a VL FR2 having an amino acid sequence selected from the group consisting of SEQ ID NOS:76, 80, 284, 92, 1038-1044, 1062-1067, and 1823-1826; (3) a VL FR3 having an amino acid sequence selected from the group consisting of SEQ ID NOS:77, 276, 81, 285-291, 93, 1049-1055, 1068, 1069, 1689-1714, and 1901; and/or (4) a VL FR4 having an amino acid of SEQ ID NO:78. Accordingly, in some aspects, the humanized antibody comprises a VL region that includes a VL FR1 having an amino acid sequence selected from the group consisting of SEQ ID NOS:75, 252, 79, 277-283, 91, 1031-1037, 1059-1061, 1615-1629, 1743, 1877, and 1878. In some aspects, the humanized antibody comprises a VL region that includes a VL FR2 having an amino acid sequence selected from the group consisting of SEQ ID NOS:76, 80, 284, 92, 1038-1044, 1062-1067, and 1823-1826. In some aspects, the humanized antibody comprises a VL region that includes a VL FR3 having an amino acid sequence selected from the group consisting of SEQ ID NOS:77, 276, 81, 285-291, 93, 1049-1055, 1068, 1069, 1689-1714, and 1901. In some aspects, the humanized antibody comprises a VL region that includes a VL FR4 having an amino acid of SEQ ID NO:78.

In certain embodiments, a humanized antibody that binds to C10orf54 (e.g., C10orf54 polypeptide, C10orf54 polypeptide fragment, C10orf54 epitope) comprises a VH region and a VL region, wherein the VH region further comprises: (1) a VH FR1 having an amino acid sequence selected from the group consisting of SEQ ID NOS:51, 105, 55, 115-121, 39, 58, 895-902, 1550-1555, 1649-1652, 1715, 1716, 1827, and 1828; (2) a VH FR2 having an amino acid sequence selected from the group consisting of SEQ ID NOS:52, 106, 56, 122-124, 63, 64, and 323-326; (3) a VH FR3 having an amino acid sequence selected from the group consisting of SEQ ID NOS:53, 107-113, 57, 125-251, 96-98, 292-318, 327-833, 53, 859-882, 903-1030, 1560-1614, 1653-1679, 1721-1742, and 1848-1875; and/or (4) a VH FR4 having an amino acid sequence of SEQ ID NO:54, 320, 168054, 320, 1680; and wherein the VL region further comprises: (1) a VL FR1 having an amino acid sequence selected from the group consisting of SEQ ID NOS:75, 252, 79, 277-283, 91, 1031-1037, 1059-1061, 1615-1629, 1743, 1877, and 1878; (2) a VL FR2 having an amino acid sequence selected from the group consisting of SEQ ID NOS:76, 80, 284, 92, 1038-1044, 1062-1067, and 1823-1826; (3) a VL FR3 having an amino acid sequence selected from the group consisting of SEQ ID NOS:77, 276, 81, 285-291, 93, 1049-1055, 1068, 1069, 1689-1714, and 1901; and/or (4) a VL FR4 having an amino acid of SEQ ID NO:78.

Also provided herein are antibodies comprising one or more (e.g., one, two, three or four) VH FRs and one or more VL FRs listed in Tables 5-11. In particular, provided herein is an antibody comprising a VH FR1 (SEQ ID NOS:51, 105, 55, 115-121, 39, 58, 895-902, 1550-1555, 1649-1652, 1715, 1716, 1827 or 1828) and a VL FR1 (SEQ ID NOS:75, 252, 79, 277-283, 91, 1031-1037, 1059-1061, 1615-1629, 1743, 1877 or 18781037, 1059-1061, 1615-1629, 1743, 1877 or 1878); a VH FR1 (SEQ ID NOS:51, 105, 55, 115-121, 39, 58, 895-902, 1550-1555, 1649-1652, 1715, 1716, 1827 or 1828) and a VL FR2 (SEQ ID NOS:76, 80, 284, 92, 1038-1044, 1062-1067 or 1823-18261044, 1062-1067 or 1823-1826); a VH FR1 (SEQ ID NOS:51, 105, 55, 115-121, 39, 58, 895-902, 1550-1555, 1649-1652, 1715, 1716, 1827 or 1828) and a VL FR3 (SEQ ID NOS:77, 276, 81, 285-291, 93, 1049-1055, 1068, 1069, 1689-1714 or 19011068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828) and a VL FR4 (SEQ ID NO:78); a VH FR2 (SEQ ID NOS:52, 106, 56, 122-124, 63, 64 or 323-326) and a VL FR1 (SEQ ID NOS:75, 252, 79, 277-283, 91, 1031-1037, 1059-1061, 1615-1629, 1743, 1877 or 18781037, 1059-1061, 1615-1629, 1743, 1877 or 1878); a VH FR2 (SEQ ID NOS:52, 106, 56, 122-124, 63, 64 or 323-326) and a VL FR2 (SEQ ID NOS:76, 80, 284, 92, 1038-1044, 1062-1067 or 1823-18261044, 1062-1067 or 1823-1826); a VH FR2 (SEQ ID NOS:52, 106, 56, 122-124, 63, 64 or 323-326) and a VL FR3 (SEQ ID NOS:77, 276, 81, 285-291, 93, 1049-1055, 1068, 1069, 1689-1714 or 19011068, 1069, 1689-1714 or 1901); a VH FR2 (SEQ ID NOS:52, 106, 56, 122-124, 63, 64 or 323-326) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875882, 903-1030, 1560-1614, 1653-1679, 1721-1742 or 1848-1875) and a VH FR1 (SEQ ID NOS:51, 105, 55, 115-121, 39, 58, 895-902, 1550-1555, 1649-1652, 1715, 1716, 1827 or 1828); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875882, 903-1030, 1560-1614, 1653-1679, 1721-1742 or 1848-1875) and a VL FR2 (SEQ ID NOS:76, 80, 284, 92, 1038-1044, 1062-1067 or 1823-1826); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875882, 903-1030, 1560-1614, 1653-1679, 1721-1742 or 1848-1875) and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875882, 903-1030, 1560-1614, 1653-1679, 1721-1742 or 1848-1875) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326) and a VL FR1 (SEQ ID NOS:75, 252, 79, 277-283, 91, 1031-1037, 1059-1061, 1615-1629, 1743, 1877 or 1878); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875882, 903-1030, 1560-1614, 1653-1679, 1721-1742 or 1848-1875) and a VL FR1 (SEQ ID NOS:75, 252, 79, 277-283, 91, 1031-1037, 1059-1061, 1615-1629, 1743, 1877 or 1878), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR2 (SEQ ID NOS:76, 80, 284, 92, 1038-1044, 1062-1067 or 1823-1826); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VL FR2 (SEQ ID NOS:76, 80, 284, 92, 1038-1044, 1062-1067 or 1823-1826) and a VL FR4 (SEQ ID NO:78); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR2 (SEQ ID NOS:52, 106, 56, 122-124, 63, 64 or 323-326), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VL FR2 (SEQ ID NOS:76, 80, 284, 92, 1038-1044, 1062-1067 or 1823-1826) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR4 (SEQ ID NO:78); a VH FR4 (SEQ ID NO:54, 320, 168054, 320, 1680), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR4 (SEQ ID NO:54, 320, 1680), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR4 (SEQ ID NO:54, 320, 1680), a VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR1 (SEQ ID NOS:75, 252, 79, 277-283, 91, 1031-1037, 1059-1061, 1615-1629, 1743, 1877 or 1878); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680) and a VL FR1 (SEQ ID NOS:75, 252, 79, 277-283, 91, 1031-1037, 1059-1061, 1615-1629, 1743, 1877 or 1878); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR1 (SEQ ID NOS:75, 252, 79, 277-283, 91, 1031-1037, 1059-1061, 1615-1629, 1743, 1877 or 1878); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR1 (SEQ ID NOS:75, 252, 79, 277-283, 91, 1031-1037, 1059-1061, 1615-1629, 1743, 1877 or 1878); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR2 (SEQ ID NOS:76, 80, 284, 92, 1038-1044, 1062-1067 or 1823-1826); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878)

and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS: 75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS: 75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2

(SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR2 (SEQ ID NOS:76, 80, 284, 92, 1038-1044, 1062-1067 or 1823-1826) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR4 (SEQ ID NO:54, 320, 1680), a VL FR2 (SEQ ID NOS:76, 80, 284, 92, 1038-1044, 1062-1067 or 1823-1826) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR3 (SEQ ID NOS:77, 276, 81, 285-291, 93, 1049-1055, 1068, 1069, 1689-1714 or 1901) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR4 (SEQ ID NO:78); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS: 75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901) and a VL FR4 (SEQ ID NO:78); a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826) and a VL FR4 (SEQ ID NO:78); a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901) and a VL FR4 (SEQ ID NO:78); a VH FR4 (SEQ ID NO:54, 320, 1680), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR1 (SEQ ID NOS:75, 252, 79, 277-283, 91, 1031-1037, 1059-1061, 1615-1629, 1743, 1877 or 1878); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878)

and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901), and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901), and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR3 (SEQ ID NOS:77, 276, 81, 285-291, 93, 1049-1055, 1068, 1069, 1689-1714 or 1901); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR3 (SEQ ID NOS:77, 276, 81, 285-291, 93, 1049-1055, 1068, 1069, 1689-1714 or 1901), and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS: 75, 252, 79, 277-283, 91, 1031-1037, 1059-1061, 1615-

1629, 1743, 1877 or 1878), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), a VL FR3 (SEQ ID NOS:77, 276, 81, 285-291, 93, 1049-1055, 1068, 1069, 1689-1714 or 1901), and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR1 (SEQ ID NOS: 75, 252, 79, 277-283, 91, 1031-1037, 1059-1061, 1615-1629, 1743, 1877 or 1878) and a VL FR2 (SEQ ID NOS:76, 80, 284, 92, 1038-1044, 1062-1067 or 1823-1826); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR1 (SEQ ID NOS:75, 252, 79, 277-283, 91, 1031-1037, 1059-1061, 1615-1629, 1743, 1877 or 1878) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR1 (SEQ ID NOS: 75, 252, 79, 277-283, 91, 1031-1037, 1059-1061, 1615-1629, 1743, 1877 or 1878) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR2 (SEQ ID NOS: 76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), a VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR1 (SEQ ID NOS: 75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR3 (SEQ ID NOS:77, 276, 81, 285-291, 93, 1049-1055, 1068, 1069, 1689-1714 or 1901); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR1 (SEQ ID NOS:51, 105, 55, 115-121, 39, 58, 895-902, 1550-1555, 1649-1652, 1715, 1716, 1827 or 1828), a VH FR2 (SEQ ID NOS:52, 106, 56, 122-124, 63, 64 or 323-326), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); a VH FR2 (SEQ ID NOS:52, 106, 56, 122-124, 63, 64 or 323-326), a VH FR3 (SEQ ID NOS:53, 107-113, 57, 125-251, 96-98, 292-318, 327-833, 53, 859-882, 903-1030, 1560-1614, 1653-1679, 1721-1742 or 1848-1875), a VH FR4 (SEQ ID NO:54, 320, 1680), a VL FR1 (SEQ ID NOS:75, 252, 79, 277-283, 91, 1031-1037, 1059-1061, 1615-1629, 1743, 1877 or 1878), VL FR2 (SEQ ID NOS:76, 80, 284, 92, 1038-1044, 1062-1067 or 1823-1826), VL FR3 (SEQ ID NOS:77, 276, 81, 285-291, 93, 1049-1055, 1068, 1069, 1689-1714 or 1901) and a VL FR4 (SEQ ID NO:78); or any combination thereof of the VH FRs (SEQ ID NOS:51, 105, 55, 115-121, 39, 58, 895-902, 52, 106, 56, 122-124, 63, 64, 323-326, 53, 107-113, 57, 125-251, 96-98, 292-318, 327-833, 53, 859-882 903-1030, 54, 320, 1680) and VL FRs (SEQ ID NOS:75, 252, 79, 277-283, 91, 1031-1037, 1059-1061, 76, 80, 284, 92, 1038-1044, 1062-1067, 77, 276, 81, 285-291, 93, 1049-1055, 1068, 1069, or 78) listed in Tables 5-11.

In certain embodiments, a humanized antibody that binds to A group of C10orf54 proteins or chimeric proteins described herein comprises a VH region comprising: (1) a VH FR1 having an amino acid sequence selected from the group consisting of SEQ ID NOS: 51, 1550-1555, 105, and 1649-1652; (2) a VH FR2 having an amino acid sequence selected from the group consisting of SEQ ID NOS: 52 and 106; (3) a VH FR3 having an amino acid sequence selected from the group consisting of SEQ ID NOS: 1560-1614, and 1653-1679; and/or (4) a VH FR4 having an amino acid sequence selected from the group consisting of SEQ ID NOS: 54 and 1680. In certain embodiments, a humanized antibody that binds to A group of C10orf54 proteins or chimeric proteins described herein comprises a VL region comprising: (1) a VL FR1 having an amino acid sequence selected from the group consisting of SEQ ID NOS: 1615-1629, 79, and 278; (2) a VL FR2 having an amino acid sequence selected from the group consisting of SEQ ID NOS: 92, 80, and 284; (3) a VL FR3 having an amino acid sequence selected from the group consisting of SEQ ID NOS: 1634-1648, 81, 1689-1714, 285, 286, and 288; and/or (4) a VL FR4 having an amino acid of SEQ ID NO: 78. In certain embodiments, a humanized antibody that binds to A group of C10orf54 proteins or chimeric proteins described herein comprises a VH region and a VL region, wherein the VH region further comprises: (1) a VH FR1 having an amino acid sequence selected from the group consisting of SEQ ID NOS: 51, 1550-1555, 105, and 1649-1652; (2) a VH FR2 having an amino acid sequence selected from the group consisting of SEQ ID NOS: 52 and 106; (3) a VH FR3 having an amino acid sequence selected from the group consisting of SEQ ID NOS: 1560-1614, and 1653-1679; and/or (4) a VH FR4 having an amino acid sequence selected from the group consisting of SEQ ID NOS: 54 and 1680; and wherein the VL region further comprises: (1) a VL FR1 having an amino acid sequence selected from the group consisting of SEQ ID NOS: 1615-1629, 79, and 278; (2) a VL FR2 having an amino acid sequence selected from the group consisting of SEQ ID NOS: 92, 80, and 284; (3) a VL FR3 having an amino acid sequence selected from the group consisting of SEQ ID NOS: 1634-1648, 81, 1689-1714, 285, 286, and 288; and/or (4) a VL FR4 having an amino acid sequence of SEQ ID NO: 78.

In certain embodiments, a humanized antibody that binds to A group of C10orf54 proteins or chimeric proteins described herein comprises a VH region comprising: (1) a VH FR1 having an amino acid sequence selected from the group consisting of SEQ ID NOS: 51, 39, 1715, 1716, 1550, 1827, 1828, 105, 55, and 115-121; (2) a VH FR2 having an amino acid sequence selected from the group consisting of SEQ ID NOS: 52, 106, 63, 64, 56, 323-326, and 122-124; (3) a VH FR3 having an amino acid sequence selected from the group consisting of SEQ ID NOS: 1560, 1561, 1721-1742, 1566, 1567, 1571, 1575, 1585, 1562, 1563, 1848-1875, 1565-1568, 1570-1572, 1574, 1575, 1577, 1578, 1581, 1582, 1584, 1585, 1587, 1591, 1593, 1594, 1597, 1602, 1603, 53, 107, 96-98, 292-318, 57, and 327-833; and/or (4) a VH FR4 having an amino acid sequence selected from the group consisting of SEQ ID NOS: 54 and 320. In certain embodiments, a humanized antibody that binds to A group of C10orf54 proteins or chimeric proteins described herein comprises a VL region comprising: (1) a VL FR1 having an amino acid sequence selected from the group consisting of SEQ ID NOS: 1743, 75, 252, 1878, 1877, 79, and 277-283; (2) a VL FR2 having an amino acid sequence selected from the group consisting of SEQ ID NOS: 1823-1826, 76, 80, and 284; (3) a VL FR3 having an amino acid sequence selected from the group consisting of SEQ ID NOS: 77, 276, 1901, 81, and 285-291; and/or (4) a VL FR4 having an amino acid sequence of SEQ ID NO: 78. In certain embodiments, a humanized antibody that binds to A group of C10orf54 proteins or chimeric proteins described herein comprises a VH region and a VL region, wherein the VH region further comprises: (1) a VH FR1 having an amino acid sequence selected from the group consisting of SEQ ID NOS: 51, 39, 1715, 1716, 1550, 1827, 1828, 105, 55, and 115-121; (2) a VH FR2 having an amino acid sequence selected from the group consisting of SEQ ID NOS: 52, 106, 63, 64, 56, 323-326, and 122-124; (3) a VH FR3 having an amino acid sequence selected from the group consisting of SEQ ID NOS: 1560, 1561, 1721-1742, 1566, 1567, 1571, 1575, 1585, 1562, 1563, 1848-1875, 1565-1568, 1570-1572, 1574, 1575, 1577, 1578, 1581, 1582, 1584, 1585, 1587, 1591, 1593, 1594, 1597, 1602, 1603, 53, 107, 96-98, 292-318, 57, and 327-833; and/or (4) a VH FR4 having an amino acid sequence selected from the group consisting of SEQ ID NOS: 54 and 320; and wherein the VL region further comprises: (1) a VL FR1 having an amino acid sequence selected from the group consisting of SEQ ID NOS: 1743, 75, 252, 1878, 1877, 79, and 277-283; (2) a VL FR2 having an amino acid sequence selected from the group consisting of SEQ ID NOS: 1823-1826, 76, 80, and 284; (3) a VL FR3 having an amino acid sequence selected from the group consisting of SEQ ID NOS: 77, 276, 1901, 81, and 285-291; and/or (4) a VL FR4 having an amino acid sequence of SEQ ID NO: 78.

In certain embodiments, a humanized antibody that binds to A group of C10orf54 proteins or chimeric proteins described herein comprises a VH region comprising: (1) a VH FR1 having an amino acid sequence selected from the group consisting of SEQ ID NOS: 51, 39, 105, 58, 55, 115-121, and 895-902; (2) a VH FR2 having an amino acid sequence selected from the group consisting of SEQ ID NOS: 52, 106, 56, and 122-124; (3) a VH FR3 having an amino acid sequence selected from the group consisting of SEQ ID NOS: 53, 107-113, 859-882, 57, 125-251, and 903-1030; and/or (4) a VH FR4 having an amino acid sequence of SEQ ID NO: 54. In certain embodiments, a humanized antibody that binds to A group of C10orf54 proteins or chimeric proteins described herein comprises a VL region comprising: (1) a VL FR1 having an amino acid sequence selected from the group consisting of SEQ ID NOS: 91, 1031-1037, 79, and 1059-1061; (2) a VL FR2 having an amino acid sequence selected from the group consisting of SEQ ID NOS: 92, 1038-1044, 80, 284, and 1062-1067; (3) a VL FR3 having an amino acid sequence selected from the group consisting of SEQ ID NOS: 93, 1049-1055, 81, 1068, 285, and 1069; and/or (4) a VL FR4 having an amino acid sequence of SEQ ID NO: 78. In certain embodiments, a humanized antibody that binds to A group of C10orf54 proteins or chimeric proteins described herein comprises a VH region and a VL region, wherein the VH region further comprises: (1) a VH FR1 having an amino acid sequence selected from the group consisting of SEQ ID NOS: 51, 39, 105, 58, 55, 115-121, and 895-902; (2) a VH FR2 having an amino acid sequence selected from the group consisting of SEQ ID NOS: 52, 106, 56, and 122-124; (3) a VH FR3 having an amino acid sequence selected from the group consisting of SEQ ID NOS: 53, 107-113, 859-882, 57, 125-251, and 903-1030; and/or (4) a VH FR4 having an amino acid sequence of SEQ ID NO: 54; and wherein the VL region further comprises: (1) a VL FR1 having an amino acid sequence selected from the group consisting of SEQ ID NOS: 91, 1031-1037, 79, and 1059-1061; (2) a VL FR2 having an amino acid sequence selected from the group consisting of SEQ ID NOS: 92, 1038-1044, 80, 284, and 1062-1067; (3) a VL FR3 having an amino acid sequence selected from the group consisting of SEQ ID NOS: 93, 1049-1055, 81, 1068, 285, and 1069; and/or (4) a VL FR4 having an amino acid sequence of SEQ ID NO: 78.

In some embodiments, antibodies provided herein are antibodies that bind to C10orf54 (e.g., C10orf54 polypeptide, C10orf54 polypeptide fragment, C10orf54 epitope), and include antibodies comprising derivatives of the VH domains, VH CDRs, VL domains, and VL CDRs described herein that bind to C10orf54 (e.g., C10orf54 polypeptide, C10orf54 polypeptide fragment, C10orf54 epitope). Also provided herein are antibodies comprising derivatives of the murine monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A, wherein the antibodies bind to C10orf54 (e.g., C10orf54 polypeptide, C10orf54 polypeptide fragment, C10orf54 epitope). Standard techniques known to those of skill in the art can be used to introduce mutations in the nucleotide sequence encoding an antibody, or fragment thereof, provided herein, including, for example, site-directed mutagenesis and PCR-mediated mutagenesis which results in amino acid substitutions. In certain embodiments, the derivatives include less than 25 amino acid substitutions, less than 20 amino acid substitutions, less than 15 amino acid substitutions, less than 10 amino acid substitutions, less than 5 amino acid substitutions, less than 4 amino acid substitutions, less than 3 amino acid substitutions, or less than 2 amino acid substitutions relative to the original molecule. In a specific embodiment, the derivatives have conservative amino acid substitutions are made at one or more predicted non-essential amino acid residues. A "conservative amino acid substitution" is one in which the amino acid residue is replaced with an amino acid residue having a side chain with a similar charge. Families of amino acid residues having side chains with similar charges have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed and the activity of the protein can be determined.

In one embodiment, an antibody that binds to C10orf54 (e.g., C10orf54 polypeptide, C10orf54 polypeptide fragment, C10orf54 epitope) comprises an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to the amino acid sequence of the murine monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A, or an antigen-binding fragment thereof, such as a VH domain or VL domain. In one embodiment, an antibody that binds to C10orf54 (e.g., C10orf54 polypeptide, C10orf54 polypeptide fragment, C10orf54 epitope) comprises an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to an amino acid sequence depicted in SEQ ID NOS:12-29. In another embodiment, an antibody that binds to C10orf54 (e.g., C10orf54 polypeptide, C10orf54 polypeptide fragment, C10orf54 epitope) comprises an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to an amino acid sequence depicted in Tables 5-33. In yet another embodiment, an antibody that binds to C10orf54 (e.g., C10orf54 polypeptide, C10orf54 polypeptide fragment, C10orf54 epitope) comprises a VH CDR and/or a VL CDR amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to a VH CDR amino acid sequence depicted in Tables 5-33 and/or a VL CDR amino acid sequence depicted in Tables 5-33.

In certain embodiments, the antibodies used in accordance with the methods provided herein have a high affinity for a C10orf54 polypeptide, or polypeptide fragment or epitope thereof. In one embodiment, the antibodies used in accordance with the methods provided herein have a higher affinity for a C10orf54 antibody than known antibodies (e.g., commercially available monoclonal antibodies discussed elsewhere herein). In a specific embodiment, the antibodies used in accordance with the methods provided herein have a 2- to 10-fold (or more) higher affinity for a C10orf54 antigen than a known anti-C10orf54 antibody as assessed by techniques described herein or known to one of skill in the art (e.g., a BIAcore assay). In accordance with these embodiments, the affinity of the antibodies are, in one embodiment, assessed by a BIAcore assay.

In a specific embodiment, an antibody that binds C10orf54 (e.g., C10orf54 polypeptide, C10orf54 polypeptide fragment, C10orf54 epitope) comprises an amino acid sequence of a VH domain and/or an amino acid sequence a VL domain encoded by a nucleotide sequence that hybridizes to (1) the complement of a nucleotide sequence encoding any one of the VH and/or VL domains depicted in Tables 2 and 4-10 under stringent conditions (e.g., hybridization to filter-bound DNA in 6× sodium chloride/sodium citrate (SSC) at about 45° C. followed by one or more washes in 0.2×SSC/0.1% SDS at about 50-65° C.) under highly stringent conditions (e.g., hybridization to filter-bound nucleic acid in 6×SSC at about 45° C. followed by one or more washes in 0.1×SSC/0.2% SDS at about 68° C.), or under other stringent hybridization conditions which are known to those of skill in the art (see, for example, Ausubel, F. M. et al., eds., 1989, Current Protocols in Molecular Biology, Vol. I, Green Publishing Associates, Inc. and John Wiley & Sons, Inc., New York at pages 6.3.1-6.3.6 and 2.10.3).

In another embodiment, an antibody that binds C10orf54 (e.g., C10orf54 polypeptide, C10orf54 polypeptide fragment, C10orf54 epitope) comprises an amino acid sequence of a VH CDR or an amino acid sequence of a VL CDR encoded by a nucleotide sequence that hybridizes to the complement of a nucleotide sequence encoding any one of the VH CDRs and/or VL CDRs depicted in Tables 2 and 4-10 under stringent conditions (e.g., hybridization to filter-bound DNA in 6×SSC at about 45° C. followed by one or more washes in 0.2×SSC/0.1% SDS at about 50-65° C.), under highly stringent conditions (e.g., hybridization to filter-bound nucleic acid in 6×SSC at about 45° C. followed by one or more washes in 0.1×SSC/0.2% SDS at about 68° C.), or under other stringent hybridization conditions which are known to those of skill in the art (see, for example, Ausubel, F. M. et al., eds., 1989, Current Protocols in Molecular Biology, Vol. I, Green Publishing Associates, Inc. and John Wiley & Sons, Inc., New York at pages 6.3.1-6.3.6 and 2.10.3)

In some embodiments, antibodies provided herein are chemically modified, e.g., by the covalent attachment of any type of molecule to the antibody. For example, but not by way of limitation, the antibody derivatives include antibodies that have been chemically modified, e.g., by glycosylation, acetylation, pegylation, phosphorylation, amidation, derivatization by known protecting/blocking groups, proteolytic cleavage, linkage to a cellular ligand or other protein, etc. Any of numerous chemical modifications may be carried out by known techniques, including, but not limited to specific chemical cleavage, acetylation, formulation, metabolic synthesis of tunicamycin, etc. Additionally, the antibody may contain one or more non-classical amino acids.

Also provided herein are antibodies that bind to C10orf54 (e.g., C10orf54 polypeptide, C10orf54 polypeptide fragment, C10orf54 epitope) which comprises a framework region known to those of skill in the art (e.g., a human or non-human fragment). The framework region may, for example, be naturally occurring or consensus framework regions. In specific embodiments, the framework region of an antibody provided herein is human (see, e.g., Chothia et al., 1998, J. Mol. Biol. 278:457-479 for a listing of human framework regions, which is incorporated by reference herein in its entirety). See also Kabat et al. (1991) Sequences of Proteins of Immunological Interest (U.S. Department of Health and Human Services, Washington, D.C.) 5th ed.

Also provided herein are antibodies that bind to C10orf54 (e.g., C10orf54 polypeptide, C10orf54 polypeptide fragment, C10orf54 epitope), the antibodies comprising the amino acid sequence of one or more of the CDRs of the murine monoclonal antibody 5B, 46A, 97A, 128A, 146C, 208A, 215A, 26A, 164A, 230A, 76E1, 53A, 259A, 33A, 39A, 124A, 175A, 321D, 141A, 51A, 353A, or 305A, including those also provided in Tables 5-33, or humanized variants thereof (e.g., VH CDRs or VL CDRs of Tables 5-11), and human framework regions with one or more amino acid substitutions at one, two, three or more of the following residues: (a) rare framework residues that differ between the murine antibody framework (e.g., donor antibody framework) and the human antibody framework (e.g., acceptor antibody framework); (b) Venier zone residues when differing between donor antibody framework and acceptor antibody framework; (c) interchain packing residues at the VH/VL interface that differ between the donor antibody framework and the acceptor antibody framework; (d) canonical residues which differ between the donor antibody framework and the acceptor antibody framework sequences, particularly the framework regions crucial for the definition of the canonical class of the murine antibody CDR loops; (e) residues that are adjacent to a CDR; (g) residues capable of interacting with the antigen; (h) residues capable of interacting with the CDR; and (i) contact residues between the VH domain and the VL domain. In certain embodiments, antibodies that bind to a C10orf54 antigen comprising the human framework regions with one or more amino acid substitutions at one, two, three or more of the above-identified residues are antagonistic C10orf54 antibodies. In certain embodiments, antibodies that bind to a C10orf54 antigen comprising the human framework regions with one or more amino acid substitutions at one, two, three or more of the above-identified residues are agonistic C10orf54 antibodies.

Antibodies provided herein include, but are not limited to, synthetic antibodies, monoclonal antibodies, recombinantly produced antibodies, multispecific antibodies (including bi-specific antibodies), human antibodies, humanized antibodies, camelized antibodies, chimeric antibodies, intrabodies, anti-idiotypic (anti-Id) antibodies, and functional fragments of any of the above. Non-limiting examples of functional fragments include single-chain Fvs (scFv) (e.g., including monospecific, bispecific, etc.), Fab fragments, F(ab') fragments, F(ab)$_2$ fragments, F(ab')$_2$ fragments, disulfide-linked Fvs (sdFv), Fd fragments, Fv fragments, diabody, triabody, tetrabody and minibody.

In particular, antibodies provided herein include immunoglobulin molecules and immunologically active portions of immunoglobulin molecules, e.g., molecules that contain an antigen binding site that bind to C10orf54 (e.g., C10orf54 polypeptide, C10orf54 polypeptide fragment, C10orf54 epitope). The immunoglobulin molecules provided herein can be of any type (e.g., IgG, IgE, IgM, IgD, IgA and IgY), class (e.g., IgG1, IgG2, IgG3, IgG4, IgA1 and IgA2) or subclass of immunoglobulin molecule.

Variants and derivatives of antibodies include antibody functional fragments that retain the ability to bind to C10orf54 (e.g., C10orf54 polypeptide, C10orf54 polypeptide fragment, C10orf54 epitope). Exemplary functional fragments include Fab fragments (an antibody fragment that contains the antigen-binding domain and comprises a light chain and part of a heavy chain bridged by a disulfide bond); Fab' (an antibody fragment containing a single anti-binding domain comprising an Fab and an additional portion of the heavy chain through the hinge region); F(ab')$_2$ (two Fab' molecules joined by interchain disulfide bonds in the hinge regions of the heavy chains; the Fab' molecules may be directed toward the same or different epitopes); a bispecific Fab (a Fab molecule having two antigen binding domains, each of which may be directed to a different epitope); a single chain Fab chain comprising a variable region, also known as, a sFv (the variable, antigen-binding determinative region of a single light and heavy chain of an antibody linked together by a chain of 10-25 amino acids); a disulfide-linked Fv, or dsFv (the variable, antigen-binding determinative region of a single light and heavy chain of an antibody linked together by a disulfide bond); a camelized VH (the variable, antigen-binding determinative region of a single heavy chain of an antibody in which some amino acids at the VH interface are those found in the heavy chain of naturally occurring camel antibodies); a bispecific sFv (a sFv or a dsFv molecule having two antigen-binding domains, each of which may be directed to a different epitope); a diabody (a dimerized sFv formed when the VH domain of a first sFv assembles with the VL domain of a second sFv and the VL domain of the first sFv assembles with the VH domain of the second sFv; the two antigen-binding regions of the diabody may be directed towards the same or different epitopes); and a triabody (a trimerized sFv, formed in a manner similar to a diabody, but in which three antigen-binding domains are created in a single complex; the three antigen binding domains may be directed towards the same or different epitopes). Derivatives of antibodies also include one or more CDR sequences of an antibody combining site. The CDR sequences may be linked together on a scaffold when two or more CDR sequences are present. In certain embodiments, the antibody comprises a single-chain Fv ("scFv"). scFvs are antibody fragments comprising the VH and VL domains of an antibody, wherein these domains are present in a single polypeptide chain. Generally, the scFv polypeptide further comprises a polypeptide linker between the VH and VL domains which enables the scFv to form the desired structure for antigen binding. For a review of scFvs see Pluckthun in *The Pharmacology of Monoclonal Antibodies*, vol. 113, Rosenburg and Moore eds. Springer-Verlag, New York, pp. 269-315 (1994).

The antibodies provided herein may be monospecific, bispecific, trispecific or of greater multispecificity. Multispecific antibodies may be specific for different epitopes of a C10orf54 polypeptide or may be specific for both a C10orf54 polypeptide as well as for a heterologous epitope, such as a heterologous polypeptide or solid support material. In specific embodiments, the antibodies provided herein are monospecific for a given epitope of a C10orf54 polypeptide and do not bind to other epitopes.

Also provided herein are fusion proteins comprising an antibody provided herein that binds to a C10orf54 antigen and a heterologous polypeptide. In some embodiments, the heterologous polypeptide to which the antibody is fused is useful for targeting the antibody to cells having cell surface-expressed C10orf54.

Also provided herein are panels of antibodies that bind to a C10orf54 antigen. In specific embodiments, panels of antibodies have different association rate constants different dissociation rate constants, different affinities for C10orf54 antigen, and/or different specificities for a C10orf54 antigen. In some embodiments, the panels comprise or consist of about 10, about 25, about 50, about 75, about 100, about 125, about 150, about 175, about 200, about 250, about 300, about 350, about 400, about 450, about 500, about 550, about 600, about 650, about 700, about 750, about 800, about 850, about 900, about 950, or about 1000 antibodies or more. Panels of antibodies can be used, for example, in 96 well or 384 well plates, such as for assays such as ELISAs.

Antibody Conjugates and Fusion Proteins

In some embodiments, antibodies provided herein are conjugated or recombinantly fused to a diagnostic, detectable or therapeutic agent or any other molecule. The conjugated or recombinantly fused antibodies can be useful, e.g., for monitoring or prognosing the onset, development, progression and/or severity of a C10orf54-mediated disease as part of a clinical testing procedure, such as determining the efficacy of a particular therapy.

Such diagnosis and detection can accomplished, for example, by coupling the antibody to detectable substances including, but not limited to, various enzymes, such as, but not limited to, horseradish peroxidase, alkaline phosphatase, beta-galactosidase, or acetylcholinesterase; prosthetic groups, such as, but not limited to, streptavidin/biotin and avidin/biotin; fluorescent materials, such as, but not limited to, umbelliferone, fluorescein, fluorescein isothiocynate, rhodamine, dichlorotriazinylamine fluorescein, dansyl chloride or phycoerythrin; luminescent materials, such as, but not limited to, luminol; bioluminescent materials, such as but not limited to, luciferase, luciferin, and aequorin; chemiluminescent material, such as but not limited to, an acridinium based compound or a HALOTAG; radioactive materials, such as, but not limited to, iodine ($^{131}$I, $^{125}$I, $^{123}$I, and $^{121}$I,), carbon ($^{14}$C), sulfur ($^{35}$S), tritium ($^{3}$H), indium ($^{115}$In, $^{113}$In, $^{112}$In, and $^{111}$In,), technetium ($^{99}$Tc), thallium ($^{201}$Ti), gallium ($^{68}$Ga, $^{67}$Ga), palladium ($^{103}$Pd), molybdenum ($^{99}$Mo), xenon ($^{133}$Xe) fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{113}$Sn and $^{117}$Sn; and positron emitting metals using various positron emission tomographies, and non-radioactive paramagnetic metal ions.

Also provided herein are antibodies that are conjugated or recombinantly fused to a therapeutic moiety (or one or more therapeutic moieties), as well as uses thereof. The antibody may be conjugated or recombinantly fused to a therapeutic moiety, such as a cytotoxin, e.g., a cytostatic or cytocidal agent, a therapeutic agent or a radioactive metal ion, e.g., alpha-emitters. A cytotoxin or cytotoxic agent includes any agent that is detrimental to cells. Therapeutic moieties include, but are not limited to, antimetabolites (e.g., methotrexate, 6-mercaptopurine, 6-thioguanine, cytarabine, 5-fluorouracil decarbazine); alkylating agents (e.g., mechlorethamine, thioepa chlorambucil, melphalan, carmustine (BCNU) and lomustine (CCNU), cyclothosphamide, busulfan, dibromomannitol, streptozotocin, mitomycin C, and cisdichlorodiamine platinum (II) (DDP), and cisplatin); anthracyclines (e.g., daunorubicin (formerly daunomycin) and doxorubicin); antibiotics (e.g., d actinomycin (formerly actinomycin), bleomycin, mithramycin, and anthramycin (AMC)); Auristatin molecules (e.g., auristatin PHE, auristatin F, monomethyl auristatin E, bryostatin and solastatin 10; see Woyke et al., Antimicrob. Agents Chemother. 46:3802-8 (2002), Woyke et al., Antimicrob. Agents Chemother. 45:3580-4 (2001), Mohammad et al., Anticancer Drugs 12:735-40 (2001), Wall et al., Biochem. Biophys. Res. Commun. 266:76-80 (1999), Mohammad et al., Int. J. Oncol. 15:367-72 (1999), all of which are incorporated herein by reference); hormones (e.g., glucocorticoids, progestins, androgens, and estrogens), DNA-repair enzyme inhibitors (e.g., etoposide or topotecan), kinase inhibitors (e.g., compound ST1571, imatinib mesylate (Kantarjian et al., Clin Cancer Res. 8(7):2167-76 (2002)); cytotoxic agents (e.g., paclitaxel, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucorticoids, procaine, tetracaine, lidocaine, propranolol, and puromycin and analogs or homologs thereof and those compounds disclosed in U.S. Pat. Nos. 6,245,759, 6,399,633, 6,383,790, 6,335,156, 6,271,242, 6,242,196, 6,218,410, 6,218,372, 6,057,300, 6,034,053, 5,985,877, 5,958,769, 5,925,376, 5,922,844, 5,911,995, 5,872,223, 5,863,904, 5,840,745, 5,728,868, 5,648,239, 5,587,459); farnesyl transferase inhibitors (e.g., R115777, BMS-214662, and those disclosed by, for example, U.S. Pat. Nos. 6,458,935, 6,451,812, 6,440,974, 6,436,960, 6,432,959, 6,420,387, 6,414,145, 6,410,541, 6,410,539, 6,403,581, 6,399,615, 6,387,905, 6,372,747, 6,369,034, 6,362,188, 6,342,765, 6,342,487, 6,300,501, 6,268,363, 6,265,422, 6,248,756, 6,239,140, 6,232,338, 6,228,865, 6,228,856, 6,225,322, 6,218,406, 6,211,193, 6,187,786, 6,169,096, 6,159,984, 6,143,766, 6,133,303, 6,127,366, 6,124,465, 6,124,295, 6,103,723, 6,093,737, 6,090,948, 6,080,870, 6,077,853, 6,071,935, 6,066,738, 6,063,930, 6,054,466, 6,051,582, 6,051,574, and 6,040,305); topoisomerase inhibitors (e.g., camptothecin; irinotecan; SN-38; topotecan; 9-aminocamptothecin; GG-211 (GI 147211); DX-8951f; IST-622; rubitecan; pyrazoloacridine; XR-5000; saintopin; UCE6; UCE1022; TAN-1518A; TAN 1518B; KT6006; KT6528; ED-110; NB-506; ED-110; NB-506; and rebeccamycin); bulgarein; DNA minor groove binders such as Hoescht dye 33342 and Hoechst dye 33258; nitidine; fagaronine; epiberberine; coralyne; beta-lapachone; BC-4-1; bisphosphonates (e.g., alendronate, cimadronte, clodronate, tiludronate, etidronate, ibandronate, neridronate, olpandronate, risedronate, piridronate, pamidronate, zolendronate) HMG-CoA reductase inhibitors, (e.g., lovastatin, simvastatin, atorvastatin, pravastatin, fluvastatin, statin, cerivastatin, lescol, lupitor, rosuvastatin and atorvastatin); antisense oligonucleotides (e.g., those disclosed in the U.S. Pat. Nos. 6,277,832, 5,998,596, 5,885,834, 5,734,033, and 5,618,709); adenosine deaminase inhibitors (e.g., Fludarabine phosphate and 2-Chlorodeoxyadenosine); ibritumomab tiuxetan (Zevalin®); tositumomab (Bexxar®)) and pharmaceutically acceptable salts, solvates, clathrates, and prodrugs thereof.

Further, an antibody provided herein may be conjugated or recombinantly fused to a therapeutic moiety or drug moiety that modifies a given biological response. Therapeutic moieties or drug moieties are not to be construed as limited to classical chemical therapeutic agents. For example, the drug moiety may be a protein, peptide, or polypeptide possessing a desired biological activity. Such proteins may include, for example, a toxin such as abrin, ricin A, pseudomonas exotoxin, cholera toxin, or diphtheria toxin; a protein such as tumor necrosis factor, γ-interferon, α-interferon, nerve growth factor, platelet derived growth factor, tissue plasminogen activator, an apoptotic agent, e.g., TNF-γ, TNF-γ, AIM I (see, International Publication No. WO 97/33899), AIM II (see, International Publication No. WO 97/34911), Fas Ligand (Takahashi et al., 1994, J. Immunol., 6:1567-1574), and VEGF (see, International Publication No. WO 99/23105), an anti-angiogenic agent, e.g., angiostatin, endostatin or a component of the coagulation pathway (e.g., tissue factor); or, a biological response modifier such as, for example, a lymphokine (e.g., interferon gamma, interleukin-1 ("IL-1"), interleukin-2 ("IL-2"), interleukin-5 ("IL-5"), interleukin-6 ("IL-6"), interleukin-7 ("IL-7"), interleukin 9 ("IL-9"), interleukin-10 ("IL-10"), interleukin-12 ("IL-12"), interleukin-15 ("IL-15"), interleukin-23 ("IL-23"), granulocyte macrophage colony stimulating factor ("GM-CSF"), and granulocyte colony stimulating factor ("G-CSF")), or a growth factor (e.g., growth hormone ("GH")), or a coagulation agent (e.g., calcium, vitamin K, tissue factors, such as but not limited to, Hageman factor (factor XII), high-molecular-weight kininogen (HMWK), prekallikrein (PK), coagulation proteins-factors II (prothrombin), factor V, XIIa, VIII, XIIIa, XI, XIa, IX, IXa, X, phospholipid, and fibrin monomer).

Also provided herein are antibodies that are recombinantly fused or chemically conjugated (covalent or non-covalent conjugations) to a heterologous protein or polypeptide (or fragment thereof, for example, to a polypeptide of about 10, about 20, about 30, about 40, about 50, about 60, about 70, about 80, about 90 or about 100 amino acids) to generate fusion proteins, as well as uses thereof. In particular, provided herein are fusion proteins comprising an antigen-binding fragment of an antibody provided herein (e.g., a Fab fragment, Fd fragment, Fv fragment, F(ab)$_2$ fragment, a VH domain, a VH CDR, a VL domain or a VL CDR) and a heterologous protein, polypeptide, or peptide. In one embodiment, the heterologous protein, polypeptide, or peptide that the antibody is fused to is useful for targeting the antibody to a particular cell type, such as a cell that expresses C10orf54 or an C10orf54 receptor. For example, an antibody that binds to a cell surface receptor expressed by a particular cell type (e.g., an immune cell) may be fused or conjugated to a modified antibody provided herein.

A conjugated or fusion protein can comprise any antibody provided herein described herein and a heterologous polypeptide. In one embodiment, a conjugated or fusion protein provided herein comprises the VH or VL domain of any one of the murine monoclonal antibodies 5B, 46A, 97A, 128A, 146C, 208A, 215A, 26A, 164A, 230A, 76E1, 53A, 259A, 33A, 39A, 124A, 175A, 321D, 141A, 51A, 353A, or 305A, as depicted in Table 2, and a heterologous polypeptide. In another embodiment, a conjugated or fusion protein provided herein comprises a VH domain having the amino acid sequence of any one of the VH domains depicted in Tables 5-33, and/or a VL domain having the amino acid sequence of any one of the VL domains depicted Tables 5-33, and a heterologous polypeptide. In another embodiment, a conjugated or fusion protein provided herein comprises one or more VH CDRs having the amino acid sequence of any one of the VH CDRs depicted in Tables 5-33, and a heterologous polypeptide. In another embodiment, a conjugated or fusion protein comprises one or more VL CDRs having the amino acid sequence of any one of the VL CDRs depicted in Tables 5-33, and a heterologous polypeptide. In another embodiment, a conjugated or fusion protein provided herein comprises at least one VH domain and at least one VL domain depicted in Tables 5-33, and a heterologous polypeptide. In yet another embodiment, a conjugated or fusion protein provided herein comprises at least one VH CDR and at least one VL CDR depicted in Tables 5-33, and a heterologous polypeptide.

In addition, an antibody provided herein can be conjugated to therapeutic moieties such as a radioactive metal ion, such as alpha-emitters such as $^{213}$Bi or macrocyclic chelators useful for conjugating radiometal ions, including but not limited to, $^{131}$In, $^{131}$LU, $^{131}$Y, $^{131}$Ho, $^{131}$Sm, to polypeptides. In certain embodiments, the macrocyclic chelator is 1,4,7, 10-tetraazacyclododecane-N,N',N'',N'''-tetraacetic acid (DOTA) which can be attached to the antibody via a linker molecule. Such linker molecules are commonly known in the art and described in Denardo et al., 1998, *Clin Cancer Res.* 4(10):2483-90; Peterson et al., 1999, *Bioconjug. Chem.* 10(4):553-7; and Zimmerman et al., 1999, *Nucl. Med. Biol.* 26(8):943-50, each incorporated by reference in their entireties.

Moreover, antibodies provided herein can be fused to marker sequences, such as a peptide to facilitate purification. In specific embodiments, the marker amino acid sequence is a hexa-histidine peptide (SEQ ID NO: 19401, such as the tag provided in a pQE vector (QIAGEN, Inc.), among others, many of which are commercially available. As described in Gentz et al., 1989, Proc. Natl. Acad. Sci. USA 86:821-824, for instance, hexa-histidine (SEQ ID NO: 19401 provides for convenient purification of the fusion protein. Other peptide tags useful for purification include, but are not limited to, the hemagglutinin ("HA") tag, which corresponds to an epitope derived from the influenza hemagglutinin protein (Wilson et al., 1984, Cell 37:767), and the "FLAG" tag.

Methods for fusing or conjugating therapeutic moieties (including polypeptides) to antibodies are well known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies 84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), Thorpe et al., 1982, Immunol. Rev. 62:119-58; U.S. Pat. Nos. 5,336,603, 5,622,929, 5,359,046, 5,349,053, 5,447,851, 5,723,125, 5,783,181, 5,908,626, 5,844,095, and 5,112,946; EP 307,434; EP 367, 166; EP 394,827; PCT publications WO 91/06570, WO 96/04388, WO 96/22024, WO 97/34631, and WO 99/04813; Ashkenazi et al., Proc. Natl. Acad. Sci. USA, 88: 10535-10539, 1991; Traunecker et al., Nature, 331:84-86, 1988; Zheng et al., J. Immunol., 154:5590-5600, 1995; Vil et al., Proc. Natl. Acad. Sci. USA, 89:11337-11341, 1992, which are incorporated herein by reference in their entireties.

Fusion proteins may be generated, for example, through the techniques of gene-shuffling, motif-shuffling, exon-shuffling, and/or codon-shuffling (collectively referred to as "DNA shuffling"). DNA shuffling may be employed to alter the activities of antibodies provided herein (e.g., antibodies with higher affinities and lower dissociation rates). See, generally, U.S. Pat. Nos. 5,605,793, 5,811,238, 5,830,721, 5,834,252, and 5,837,458; Patten et al., 1997, Curr. Opinion Biotechnol. 8:724-33; Harayama, 1998, Trends Biotechnol. 16(2):76-82; Hansson et al., 1999, J. Mol. Biol. 287:265-76; and Lorenzo and Blasco, 1998, Biotechniques 24(2):308-313 (each of these patents and publications are hereby incorporated by reference in its entirety). Antibodies, or the encoded antibodies, may be altered by being subjected to random mutagenesis by error-prone PCR, random nucleotide insertion or other methods prior to recombination. A polynucleotide encoding an antibody provided herein may be recombined with one or more components, motifs, sections, parts, domains, fragments, etc. of one or more heterologous molecules.

An antibody provided herein can also be conjugated to a second antibody to form an antibody heteroconjugate as described in U.S. Pat. No. 4,676,980, which is incorporated herein by reference in its entirety.

The therapeutic moiety or drug conjugated or recombinantly fused to an antibody provided herein that binds to a C10orf54 antigen should be chosen to achieve the desired prophylactic or therapeutic effect(s). In certain embodiments, the antibody is a modified antibody. A clinician or other medical personnel should consider the following when deciding on which therapeutic moiety or drug to conjugate or recombinantly fuse to an antibody provided herein: the nature of the disease, the severity of the disease, and the condition of the subject.

Antibodies provided herein may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Antibody-Drug Conjugate (ADC)

In some embodiments, provided herein are antibody-drug conjugates, including an antibody-drug conjugate of the following formulas (Ia) and (Ib):

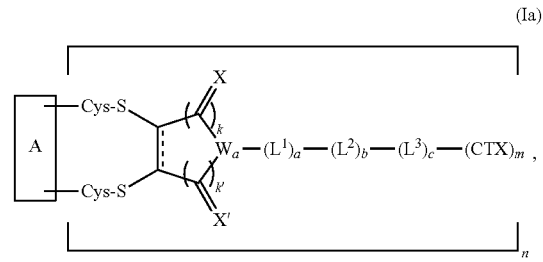

(Ia)

-continued

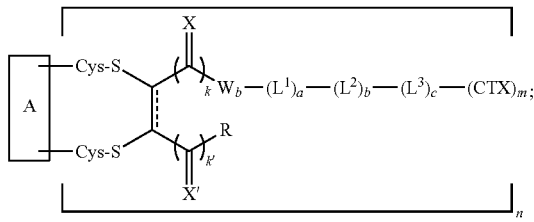

(Ib)

or a pharmaceutically acceptable salt thereof;
wherein:
A is an antibody or antibody fragment;
the two depicted cysteine residues are from an opened cysteine-cysteine disulfide bond in A;
each X and X' is independently O, S, NH, or $NR^1$ wherein $R^1$ is $C_{1-6}$ alkyl;
$W_a$ is =N—, =CH—, =CHCH$_2$—, =C(R$^2$)—, or =CHCH(R$^2$)—; $W_b$—NH—, —N(R$^1$)—, —CH$_2$—, —CH$_2$—NH—, —CH$_2$—N(R$^1$)—, —CH$_2$CH$_2$—, —CH(R$^2$)—, or —CH$_2$CH(R$^2$)—; wherein $R^1$ and $R^2$ are independently $C_{1-6}$ alkyl;
CTX is a cytotoxin;
R is any chemical group; or R is absent;
each $L^1$, $L^2$ and $L^3$ is independently a linker selected from the group consisting of —O—, —C(O)—, —S—, —S(O)—, —S(O)$_2$—, —NH—, —NCH$_3$—, —(CH$_2$)$_q$—, —NH(CH$_2$)$_2$NH—, —OC(O)—, —CO$_2$—, —NHCH$_2$CH$_2$C(O)—, —C(O)NHCH$_2$CH$_2$NH—, —NHCH$_2$C(O)—, —NHC(O)—, —C(O)NH—, —NCH$_3$C(O)—, —C(O)NCH$_3$—, —(CH$_2$CH$_2$O)$_p$—, —(CH$_2$CH$_2$O)$_p$CH$_2$CH$_2$—, —CH$_2$CH$_2$—(CH$_2$CH$_2$O)$_p$—, —OCH(CH$_2$O—)$_2$, -(AA)$_r$-, cyclopentanyl, cyclohexanyl, unsubstituted phenylenyl, and phenylenyl substituted by 1 or 2 substituents selected from the group consisting of halo, CF$_3$—, CF$_3$O—, CH$_3$O—, —C(O)OH, —C(O)OC$_{1-3}$ alkyl, —C(O)CH$_3$, —CN, —NH—, —NH$_2$, —O—, —OH, —NHCH$_3$, —N(CH$_3$)$_2$, and $C_{1-3}$ alkyl;
a, b and c are each independently an integer of 0, 1, 2 or 3, provided that at least one of a, b or c is 1;
each k and k' is independently an integer of 0 or 1;
each p is independently an integer of 1 to 14;
each q is independently an integer from 1 to 12;
each AA is independently an amino acid;
each r is 1 to 12;
m is an integer of 1 to 4;
n is an integer of 1 to 4; and
the ----- bond represents a single or a double bond.

In certain embodiments of the antibody-drug conjugate of formula (Ib), R is selected from the group consisting of W, $(L^1)_a$, $(L^2)_b$, $(L^3)_c$, Z, W-$(L^1)_a$-$(L^2)_b$-$(L^3)_c$, $(L^1)_a$-$(L^2)_b$-$(L^3)_c$-Z, and W-$(L^1)_a$-$(L^2)_b$-$(L^3)_c$-Z, as defined herein. In certain embodiments, R is selected from the group consisting of W, $(L^1)_a$, $(L^2)_b$, $(L^3)_c$, and W-$(L^1)_a$-$(L^2)_b$-$(L^3)_c$. In certain embodiments, R is selected from the group consisting of Z, $(L^1)_a$-$(L^2)_b$-$(L^3)_c$-Z, and W-$(L^1)_a$-$(L^2)_b$-$(L^3)_c$-Z.

In certain embodiments of the antibody-drug conjugate of formula (Ia) or (Ib), n is an integer of 2 (e.g., two heavy chain-light chain interchain disulfide bonds). In certain embodiments, n is an integer of 3 (e.g., two heavy chain-light chain interchain disulfide bonds and one hinge heavy chain-heavy chain interchain disulfide bond). In certain embodiments, n is an integer of 4 (e.g., two heavy chain-light chain interchain disulfide bonds and two hinge heavy chain-heavy chain interchain disulfide bonds).

In certain embodiments of the antibody-drug conjugate of formula (Ib), R is a detectable probe. In certain embodiments, R is a fluorophore, chromophore, radiolabel, enzyme, ligand, antibody or antibody fragment. In certain embodiments, R is a ligand (e.g., a ligand specific for a receptor on a tumor cell, such as a prostate specific membrane antigen, or a virally infected cell, such as an HIV infected cell).

In certain embodiments of the antibody-drug conjugate of formula (Ib), R is bonded to the rest of the linker molecule via an amide, an N—(C$_{1-6}$alkyl)amide, a carbamate, an N—(C$_{1-6}$ alkyl)carbamate, an amine, an N—(C$_{1-6}$ alkyl) amine, an ether, a thioether, an urea, an N—(C$_{1-6}$ alkyl)urea, or an N,N-di(C$_{1-6}$ alkyl)urea bond.

In certain embodiments of the antibody-drug conjugate of formula (Ia) or (Ib), each $L^1$, $L^2$ and $L^3$ is independently selected from the group consisting of —NHC(O)—, —C(O)NH—, —(CH$_2$CH$_2$O)$_p$—, —(CH$_2$CH$_2$O)$_p$CH$_2$CH$_2$—, —CH$_2$CH$_2$—(CH$_2$CH$_2$O)$_p$—, —OCH(CH$_2$O—)$_2$, -(AA)$_r$-, unsubstituted phenylenyl, and phenylenyl substituted by 1 or 2 substituents selected from the group consisting of halo, CF$_3$—, CF$_3$O—, CH$_3$O—, —C(O)OH, —C(O)OC$_{1-3}$ alkyl, —C(O)CH$_3$, —CN, —NH—, —NH$_2$, —O—, —OH, —NHCH$_3$, —N(CH$_3$)$_2$, and C$_{1-3}$ alkyl; where a, b and c are each independently 0 or 1; and each p and r is independently 1, 2 or 3. In certain embodiments, one or more of the $L^1$, $L^2$ and $L^3$ is -(AA)$_r$-, wherein -(AA)$_r$- is ValCit (e.g., the first amino acid is Valine, the second amino acid is Citrulline, and r is 1). In certain embodiments, one or more of the $L^1$, $L^2$ and $L^3$ is -(AA)$_r$-, wherein -(AA)$_r$- is ValAla (e.g., the first amino acid is Valine, the second amino acid is Alanine, and r is 1). In certain embodiments, one or more of the $L^1$, $L^2$ and $L^3$ is phenylenyl substituted by —C(O)OH and —NH$_2$. In certain embodiments, one or more of the $L^1$, $L^2$ and $L^3$ is phenylenyl substituted by —C(O)O— and —NH—. In certain embodiments, one or more of the $L^1$, $L^2$ and $L^3$ is phenylenyl substituted by —OC(O)— and —NH—. In certain embodiments, one or more of the $L^1$, $L^2$ and $L^3$ is phenylenyl substituted by —O— and —NH—. In certain embodiments, one or more of the $L^1$, $L^2$ and $L^3$ is para aminobenzyl (PAB), which is optionally substituted with —C(O)O—, —OC(O)— or —O—. In certain embodiments, $L^1$ is —(CH$_2$)$_q$—, $L^2$ is absent, $L^3$ is absent, and the CTX is bonded to $(L^1)_a$-$(L^2)_b$-$(L^3)_c$ via an amide bond. In certain embodiments, $L^1$ is —(CH$_2$)$_q$—, $L^2$ is —(OCH$_2$CH$_2$)$_p$—, $L^3$ is absent, and the CTX is bonded to $(L^1)_a$-$(L^2)_b$-$(L^3)_c$ via an amide bond. In certain embodiments, $L^1$ is —(CH$_2$CH$_2$O)$_p$—, $L^2$ is —(CH$_2$)$_q$—, $L^3$ is absent, and the CTX is bonded to $(L^1)_a$-$(L^2)_b$-$(L^3)_c$ via an amide bond. In certain embodiments, each $L^1$ is independently selected from the group consisting of —(CH$_2$CH$_2$O)$_p$CH$_2$CH$_2$— and —CH$_2$CH$_2$—(CH$_2$CH$_2$O)$_p$—, $L^2$ is absent, $L^3$ is absent, and the CTX is bonded to $(L^1)_a$-$(L^2)_b$-$(L^3)_c$ via an amide bond. In certain embodiments, each $L^1$ is independently selected from the group consisting of —(CH$_2$)$_q$—, —(CH$_2$CH$_2$O)$_p$, —(CH$_2$CH$_2$O)$_p$CH$_2$CH$_2$—, —CH$_2$CH$_2$—(CH$_2$CH$_2$O)$_p$—, and —C(O)—, $L^2$ is Val-Cit, $L^3$ is PAB, and the CTX is bonded to $(L^1)_a$-$(L^2)_b$-$(L^3)_c$ via an amide bond. In certain embodiments, each $L^1$ is independently selected from the group consisting of —(CH$_2$)$_q$—, —(CH$_2$CH$_2$O)$_p$, —(CH$_2$CH$_2$O)$_p$CH$_2$CH$_2$—, —CH$_2$CH$_2$—(CH$_2$CH$_2$O)$_p$—, and —C(O)—, $L^2$ is Val-Cit, $L^3$ is PAB, and the CTX is bonded to $(L^1)_a$-$(L^2)_b$-$(L^3)_c$ via an amide bond. In certain embodiments, each $L^1$ is independently selected from the group consisting of —(CH$_2$)$_q$—, —(CH$_2$CH$_2$O)$_p$, —(CH$_2$CH$_2$O)$_p$CH$_2$CH$_2$—, —CH$_2$CH$_2$—(CH$_2$CH$_2$O)$_p$—, and —C(O)—, $L^2$ is Val-Ala, $L^3$ is PAB, and the CTX is bonded to $(L^1)_a$-$(L^2)_b$-$(L^3)_c$ via an amide bond.

In certain embodiments of the antibody-drug conjugate of formula (Ia) or (Ib), CTX is selected from a from the group consisting of a tubulin stabilizer, a tubulin destabilizer, a DNA alkylator, a DNA minor groove binder, a DNA intercalator, a topoisomerase I inhibitor, a topoisomerase II inhibitor, a gyrase inhibitor, a protein synthesis inhibitor, a proteosome inhibitor, and an anti-metabolite.

In certain embodiments of the antibody-drug conjugate of formula (Ia) or (Ib), the CTX is a chemotherapeutic agent. Those of ordinary skill in the art will be aware of appropriate chemotherapeutic agents as disclosed, for example, in Chu, E., DeVite, V. T., 2012, Physicians' Cancer Chemotherapy Drug Manual 2012 (Jones & Bartlett Learning Oncology), and similar documents.

In certain embodiments, the CTX may be any FDA-approved chemotherapeutic agent. In certain embodiments, the CTX may be any FDA-approved chemotherapeutic agent available for cancer treatment.

In certain embodiments, the CTX is selected from the group consisting of an alkylating agents, an anthracyclines, a cytoskeletal disruptors (taxanes), an epothilones, an histone deacetylase Inhibitor (HDAC), an inhibitor of Topoisomerase I, an Inhibitor of Topoisomerase II, a kinase inhibitor, a monoclonal antibodies, a nucleotide analog, a peptide antibiotic, a platinum-based agent, a retinoids, a Vinca alkaloid or a derivative thereof, and radioisotope.

In certain embodiments, the CTX is selected from the group consisting of Actinomycin, all-trans retinoic acid, Azacitidine, Azathioprine, Bleomycin, Bortezomib, Carboplatin, Capecitabine, Cisplatin, Chlorambucil, Cyclophosphamide, Cytarabine, Daunorubicin, Docetaxel, Doxifluridine, Doxorubicin, Epirubicin, Epothilone, Etoposide, Fluorouracil, Gemcitabine, Hydroxyurea, Idarubicin, Imatinib, Irinotecan, Mechlorethamine, Mercaptopurine, Methotrexate, Mitoxantrone, Oxaliplatin, Paclitaxel, Pemetrexed, Teniposide, Tioguanine, Topotecan, Valrubicin, Vinblastine, Vincristine, Vindesine, and Vinorelbine.

In certain embodiments, the CTX is selected from the group consisting of a tubulin stabilizer, a tubulin destabilizer, a DNA alkylator, a DNA minor groove binder, a DNA intercalator, a topoisomerase I inhibitor, a topoisomerase II inhibitor, a gyrase inhibitor, a protein synthesis inhibitor, a proteosome inhibitor, and an anti-metabolite.

In certain embodiments, the CTX is selected from the group consisting of Actinomycin D, Amonafide, an auristatin, benzophenone, benzothiazole, a calicheamicin, Camptothecin, CC-1065 (NSC 298223), Cemadotin, Colchicine, Combretastatin A4, Dolastatin, Doxorubicin, Elinafide, Emtansine (DM1), Etoposide, KF-12347 (Leinamycin), a maytansinoid, Methotrexate, Mitoxantrone, Nocodazole, Proteosome Inhibitor 1 (PSI 1), Roridin A, T-2 Toxin (trichothecene analog), Taxol, a tubulysin, Velcade®, and Vincristine. In certain embodiments, the CTX is an auristatin, a calicheamicin, a maytansinoid, or a tubulysin.

In certain embodiments, the cytotoxin is a pyrrolobenzodiazepine (PBD), a calicheamicin, doxorubicin, camptothecin, duocarmycin, DM1, DM4, a maytansinoid, or a tubulysin. In certain embodiments, CTX is an auristatin, a PDB, calicheamicin, doxorubicin, camptothecin, duocarmycin, DM1, DM4, a maytansinoid, or a tubulysin.

In certain embodiments, CTX is an auristatin, such as monomethylauristatin F (MMAF) and monomethylauristatin E (MMAE). In certain embodiments, the cytotoxin is a PBD.

In certain embodiments, the CTX is MMAE, MMAF, a PDB, calicheamicin γ, mertansine, or tubulysin T2.

In certain embodiments, the CTX is MMAE or MMAF, the structures for which are provided below:

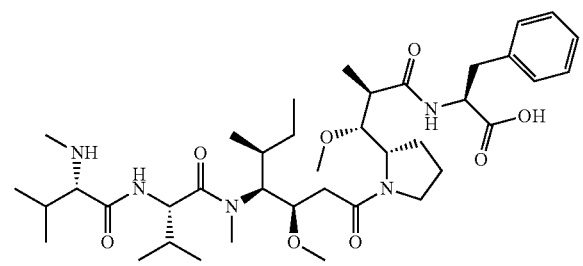

MMAF

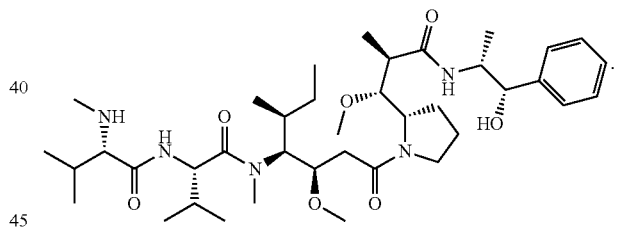

MMAE

In certain embodiments, the CTX is a PDB, selected from the group consisting of:

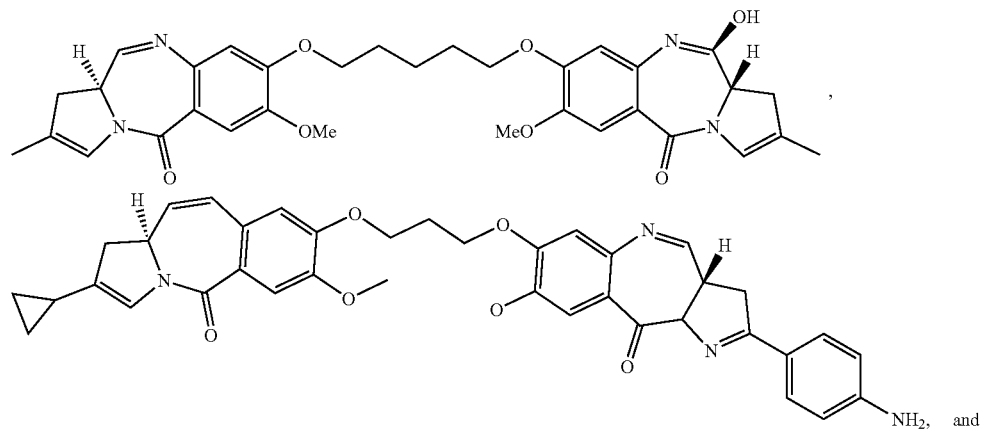

, and

-continued

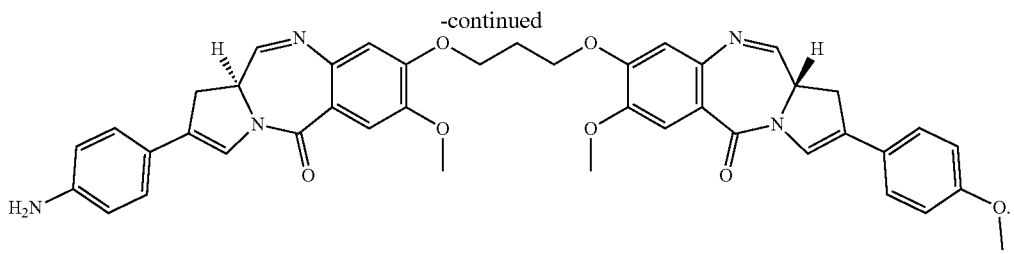

In certain embodiments, the CTX is tubulysin T2.
In certain embodiments, the CTX is tubulysin T3, or tubulysin T4, the structures for which are provided below:

T3

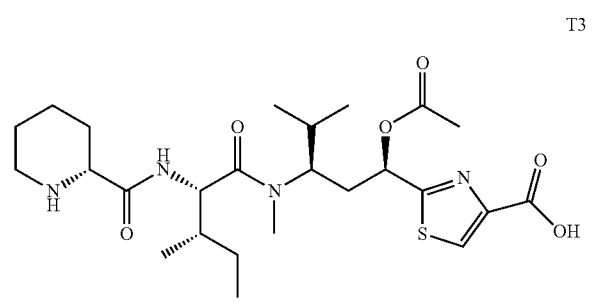

T4

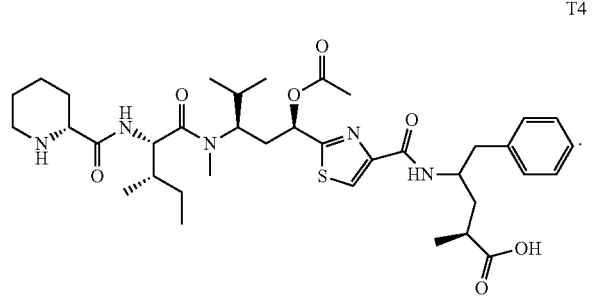

In some embodiments, provided herein are antibody-drug conjugates, including an antibody-drug conjugate of the following formula (Ic):

(Ic)

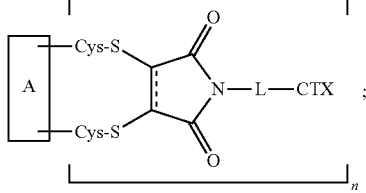

or pharmaceutically acceptable salt thereof,
wherein:
A is an anti-C10orf54 antibody, optionally a humanized anti-C10orf54 antibody;
the two depicted cysteine residues are from an opened cysteine-cysteine disulfide bond in A;
L is a cleavable or a noncleavable linker;
CTX is cytotoxin bonded to L by an amide bond, a carbamate bond, a disulfide bond, an ether bond, a thioether bond, or an ester bond;

the ----- bond represents a single or a double bond; and
n is an integer of 1 to 4.
In some embodiments, provided herein are antibody-drug conjugates, including an antibody-drug conjugate of the following formula (Ic1):

(Ic1)

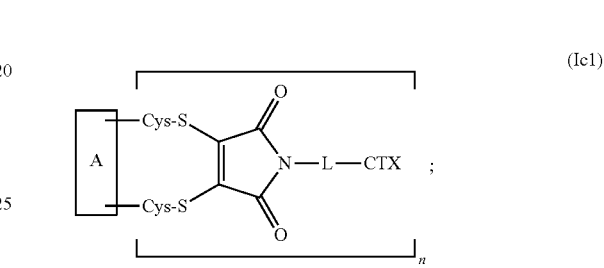

or pharmaceutically acceptable salt thereof,
wherein:
A is an anti-C10orf54 antibody, optionally a humanized anti-C10orf54 antibody;
the two depicted cysteine residues are from an opened cysteine-cysteine disulfide bond in A;
L is a cleavable or a noncleavable linker;
CTX is cytotoxin bonded to L by an amide bond, a carbamate bond, a disulfide bond, an ether bond, a thioether bond, or an ester bond; and
n is an integer of 1 to 4.
In some embodiments, provided herein are antibody-drug conjugates, including an antibody-drug conjugate of the following formula (Ic2):

(Ic2)

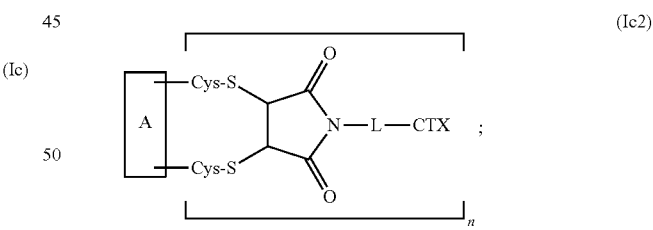

or pharmaceutically acceptable salt thereof,
wherein:
A is an anti-C10orf54 antibody, optionally a humanized anti-C10orf54 antibody;
the two depicted cysteine residues are from an opened cysteine-cysteine disulfide bond in A;
L is a cleavable or a noncleavable linker;
CTX is cytotoxin bonded to L by an amide bond, a carbamate bond, a disulfide bond, an ether bond, a thioether bond, or an ester bond; and
n is an integer of 1 to 4.
In certain embodiments of the antibody-drug conjugate of the formula (Ic), (Ic1) or (Ic2), the opened cysteine-cysteine disulfide bond in A is an interchain disulfide bond. In certain embodiments, where the opened cysteine-cysteine disulfide bond in A is an interchain disulfide bond n is 4. (e.g., two heavy chain-light chain interchain disulfide bonds and two hinge heavy chain-heavy chain interchain disulfide bonds). In certain embodiments, where the opened cysteine-cysteine disulfide bond in A is an interchain disulfide bond n is 3 (e.g., two heavy chain-light chain interchain disulfide bonds and one hinge heavy chain-heavy chain interchain disulfide bond). In certain embodiments, where the opened cysteine-cysteine disulfide bond in A is an interchain disulfide bond n is 2 (e.g., two heavy chain-light chain interchain disulfide bonds).

In certain embodiments of the antibody-drug conjugate of the formula (Ic), (Ic1) or (Ic2), CTX is an auristatin, a pyrrolobenzodiazepine (PDB), calicheamicin, doxorubicin, camptothecin, duocarmycin, DM1, DM4, a maytansinoid, or a tubulysin, wherein CTX is bonded to L by an amide bond, a carbamate bond, a disulfide bond, an ether bond, a thio-ether bond, or an ester bond. In certain embodiments, CTX is an auristatin bonded to L by an amide bond or a carbamate bond. In certain embodiments, CTX is MMAF bonded to L by an amide bond. In certain embodiments, CTX is MMAE bonded to L by a carbamate bond. In certain embodiments, CTX is a PBD bonded to L by an amide bond or a carbamate bond.

In certain embodiments of the antibody-drug conjugate of the formula (Ic), (Ic1) or (Ic2), L is a noncleavable linker.

In certain embodiments of the antibody-drug conjugate of the formula (Ic), (Ic1) or (Ic2), L is:

—($CH_2$)$_m$C(O)—,

—($CH_2CH_2O$)$_p$($CH_2CH_2$)C(O)—, or

—($CH_2CH_2$)(O$CH_2CH_2$)$_p$C(O)—;

wherein m is an integer of 5 to 11, and p is an integer of 1 to 3.

In certain embodiments of the antibody-drug conjugate of the formula (Ic), (Ic1) or (Ic2), L is a cleavable linker.

In certain embodiments of the antibody-drug conjugate of the formula (Ic), (Ic1) or (Ic2), L is:

—($CH_2$)$_m$C(O)-Val-Ala-PAB-C(O)—,

—($CH_2$)$_m$C(O)-Val-Cit-PAB-C(O)—,

—($CH_2CH_2O$)$_p$($CH_2CH_2$)C(O)-Val-Ala-PAB-C(O)—,

—($CH_2CH_2O$)$_p$($CH_2CH_2$)C(O)-Val-Cit-PAB-C(O)—,

—($CH_2CH_2$)(O$CH_2CH_2$)$_p$C(O)-Val-Ala-PAB-C(O)—, or

—($CH_2CH_2$)(O$CH_2CH_2$)$_p$C(O)-Val-Cit-PAB-C(O)—;

wherein m is an integer of 5 to 11, and p is an integer of 1 to 3; and wherein PAB has the following structure:

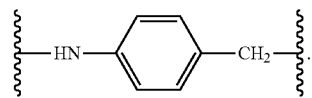

In certain embodiments of the antibody-drug conjugate of the formula (Ic), (Ic1) or (Ic2), CTX is an auristatin. In certain embodiments, the CTX is MMAF. In certain embodiments the CTX is MMAE. In certain embodiments, the CTX is a PDB.

In certain embodiments of the antibody-drug conjugate of the formula (Ic), (Ic1) or (Ic2), n is 2, 3, or 4.

In certain embodiments of the antibody-drug conjugate of the formula (Ic), (Ic1) or (Ic2), CTX is MMAF, and L is —($CH_2$)$_5$C(O)—. In certain embodiments, CTX is MMAE, and L is —($CH_2$)$_5$C(O)-Val-Ala-PAB-O—C(O)—. In certain embodiments, CTX is a PBD, and L is —($CH_2$)$_5$C(O)-Val-Ala-PAB-O—C(O)— or —($CH_2$)$_5$C(O)-Val-Cit-PAB-O—C(O)—.

In certain embodiments, the antibody-drug conjugate is of the following formula:

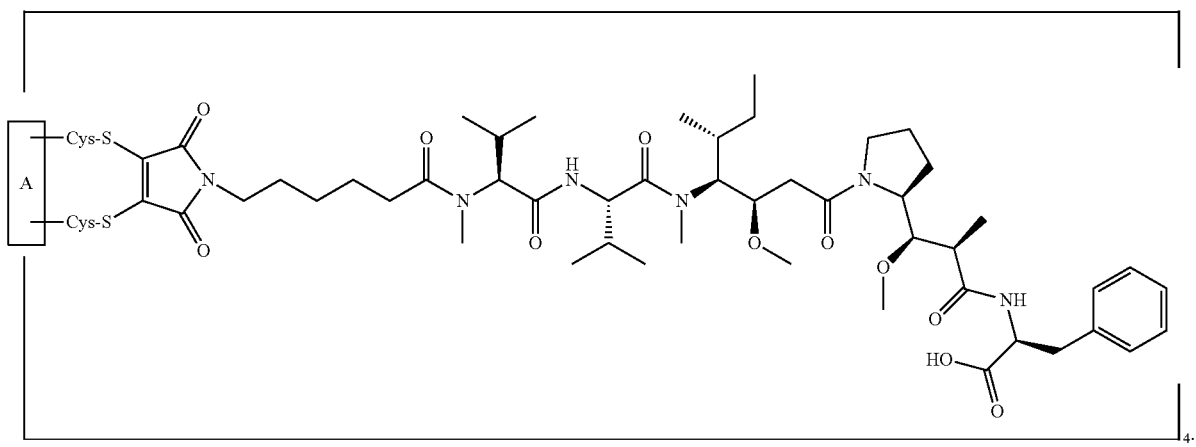

In certain embodiments, the antibody-drug conjugate is of the following formula:
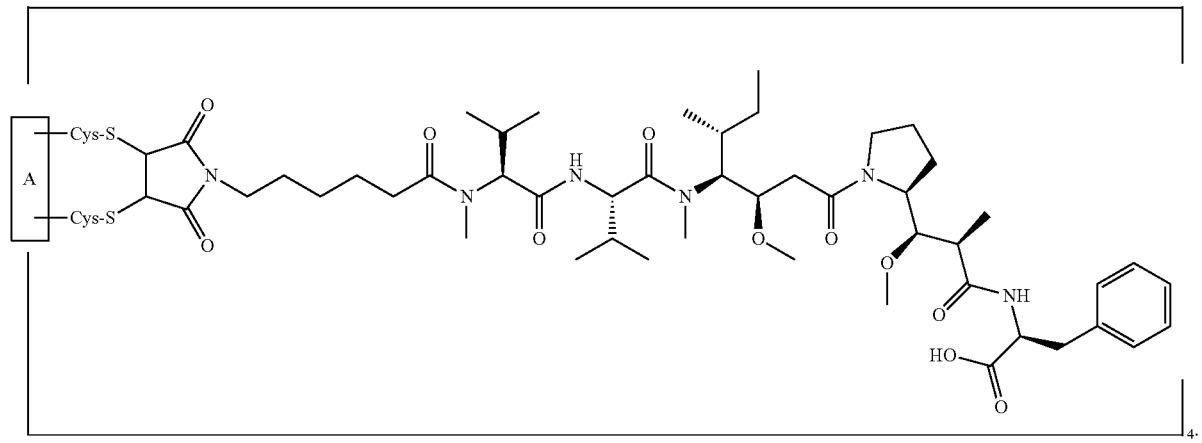
In certain embodiments, the antibody-drug conjugate is of the following formula:
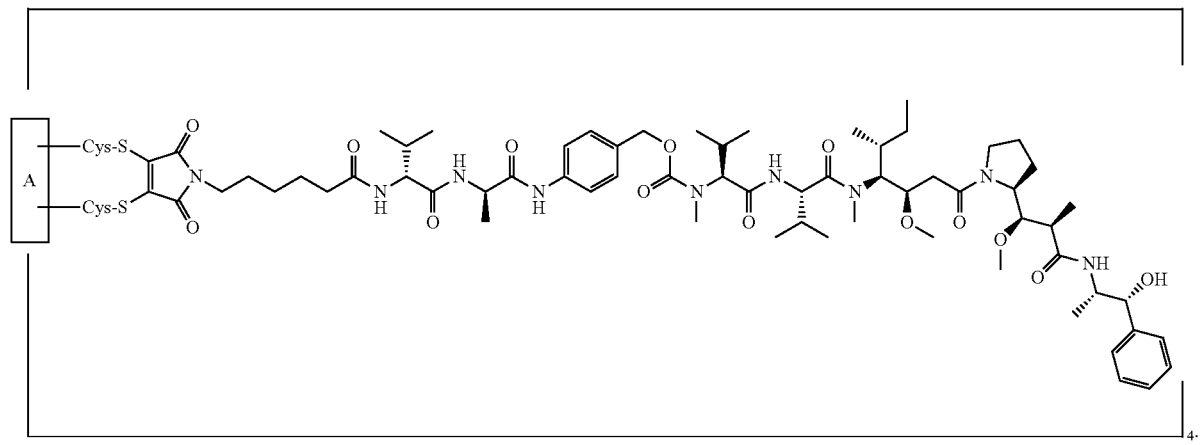
In certain embodiments, the antibody-drug conjugate is of the following formula:
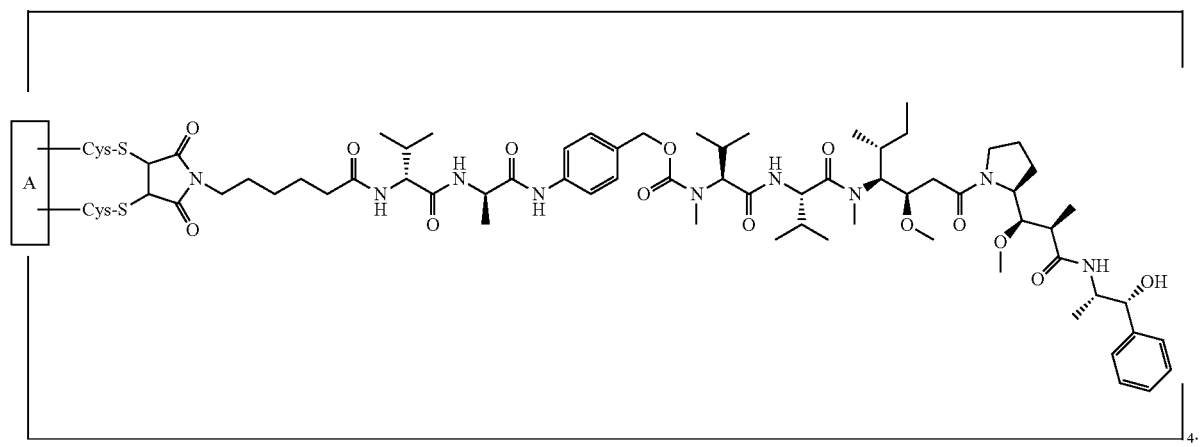

In certain embodiments, the antibody-drug conjugate is one of the following formulas:
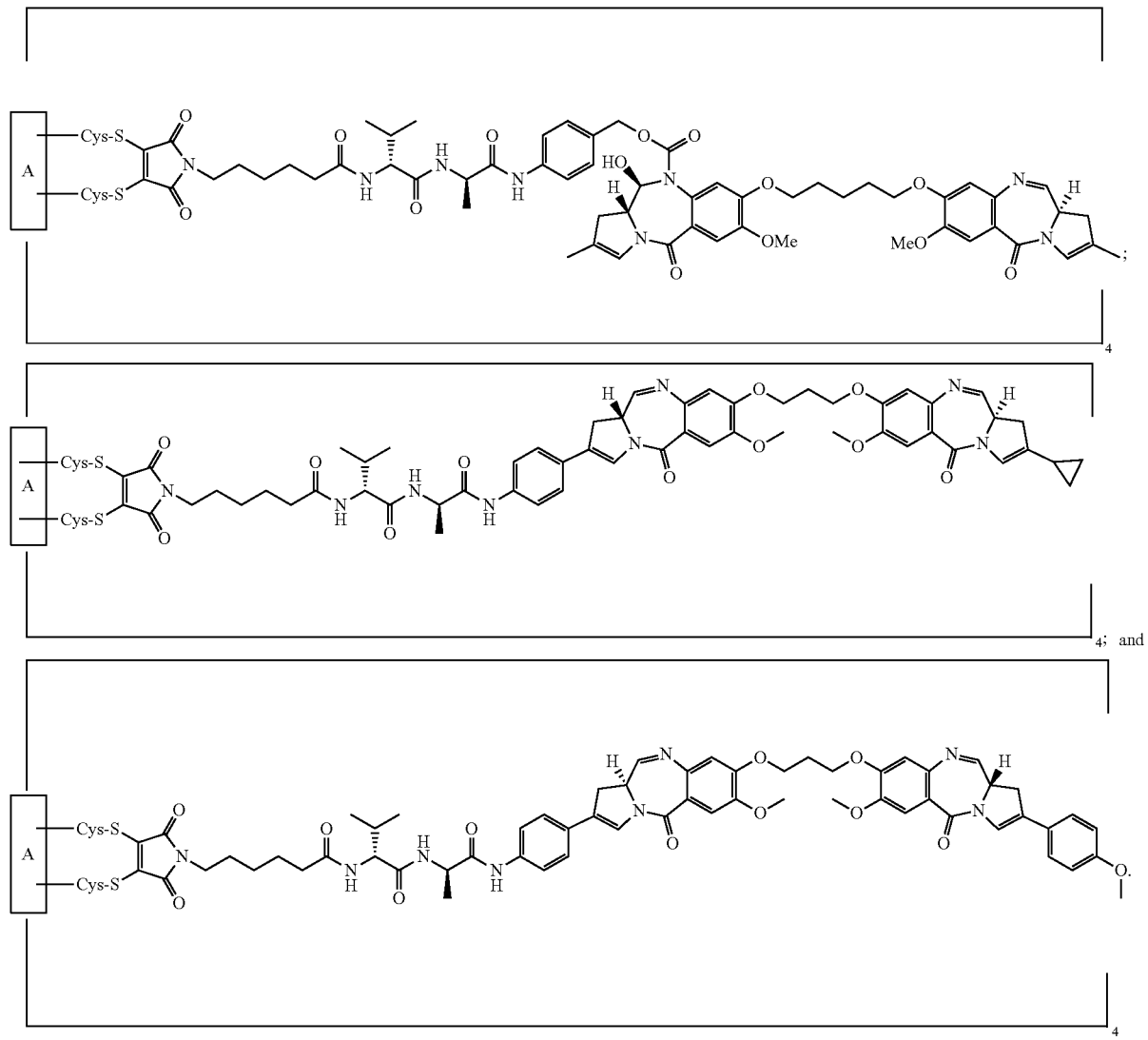
In certain embodiments, the antibody-drug conjugate is one of the following formulas:
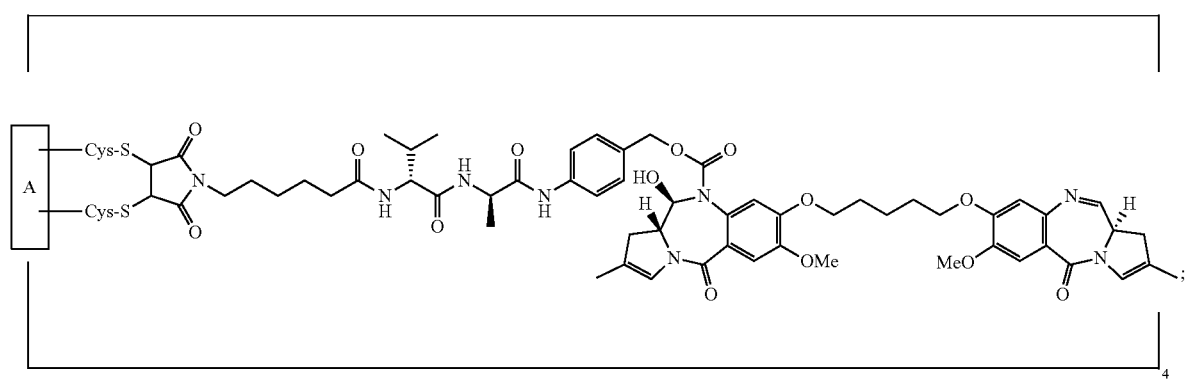

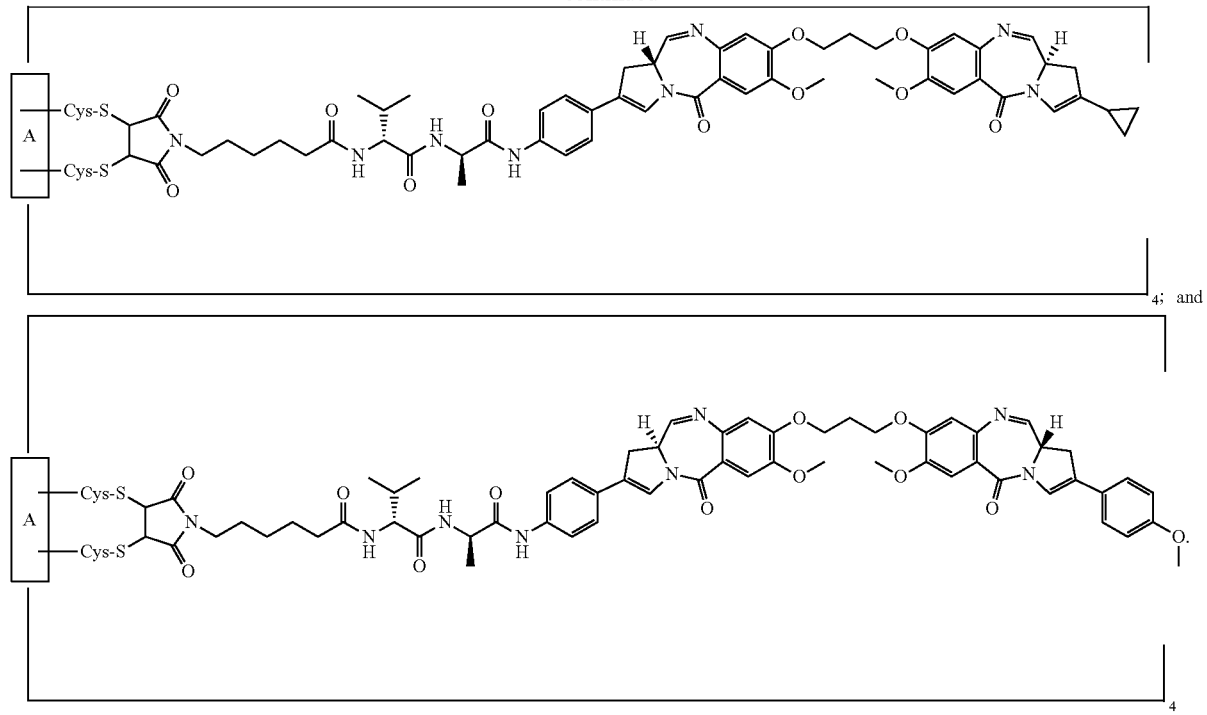

In some embodiments, provided herein is an antibody-drug conjugate of the following formula (Id):

In some embodiments, provided herein is an antibody-drug conjugate of the following formula (Id1):

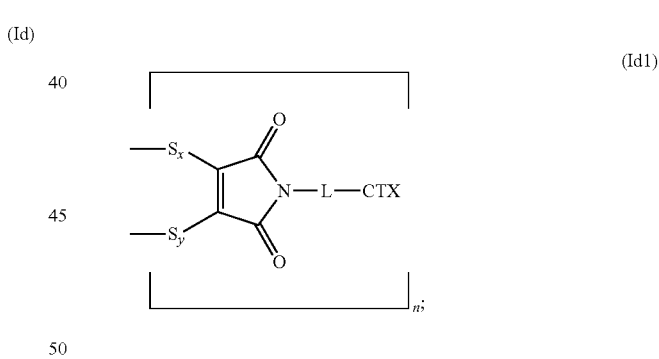

wherein:

L is a cleavable or a noncleavable linker;

CTX is a cytotoxin bonded to L by an amide bond, a carbamate bond, a disulfide bond, an ether bond, a thioether bond, or an ester bond;

$S_x$ is a sulfur atom from a first cysteine residue, and $S_y$ is a sulfur atom from a second cysteine residue, wherein the first cysteine residue and the second cysteine residue are from different chains and/or from the same chain of a multi-chain antibody;

the ------ bond represents a single or a double bond; and n is an integer of 1 to 4.

wherein:

L is a cleavable or a noncleavable linker;

CTX is a cytotoxin bonded to L by an amide bond, a carbamate bond, a disulfide bond, an ether bond, a thioether bond, or an ester bond;

$S_x$ is a sulfur atom from a first cysteine residue, and $S_y$ is a sulfur atom from a second cysteine residue, wherein the first cysteine residue and the second cysteine residue are from different chains and/or from the same chain of a multi-chain antibody; and n is an integer of 1 to 4.

In some embodiments, provided herein is an antibody-drug conjugate of the following formula (Id2):

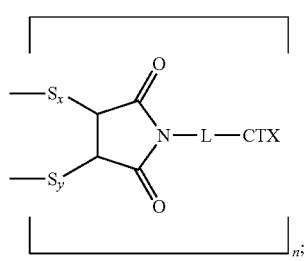

(Id2)

wherein:
L is a cleavable or a noncleavable linker;
CTX is a cytotoxin bonded to L by an amide bond, a carbamate bond, a disulfide bond, an ether bond, a thioether bond, or an ester bond;
$S_x$ is a sulfur atom from a first cysteine residue, and $S_y$ is a sulfur atom from a second cysteine residue, wherein the first cysteine residue and the second cysteine residue are from different chains and/or from the same chain of a multi-chain antibody; and
n is an integer of 1 to 4.

In certain embodiments of the antibody-drug conjugate of the formula (Id), (Id1) or (Id2), CTX is an auristatin, a pyrrolobenzodiazepine (PDB), calicheamicin, doxorubicin, camptothecin, duocarmycin, DM1, DM4, a maytansinoid, or a tubulysin, wherein CTX is bonded to L by an amide bond, a carbamate bond, a disulfide bond, an ether bond, a thioether bond, or an ester bond. In certain embodiments, CTX is an auristatin bonded to L by an amide bond or a carbamate bond. In certain embodiments, CTX is MMAF bonded to L by an amide bond. In certain embodiments, CTX is MMAE bonded to L by a carbamate bond. In certain embodiments, CTX is a PBD bonded to L by an amide bond or a carbamate bond.

In certain embodiments of the antibody-drug conjugate of the formula (Id), (Id1) or (Id2), the multi-chain antibody comprises two heavy chains and two light chains.

In certain embodiments of the antibody-drug conjugate of the formula (Id), (Id1) or (Id2), the first cysteine residue is from a first heavy chain and the second cysteine residue is from a second heavy chain of the multi-chain antibody.

In certain embodiments of the antibody-drug conjugate of the formula (Id), (Id1) or (Id2), the first cysteine residue is from a heavy chain and the second cysteine residue is from a light chain of the multi-chain antibody.

In certain embodiments of the antibody-drug conjugate of the formula (Id), (Id1) or (Id2), the first and second cysteine residues are from the same heavy chain of the multi-chain antibody.

In certain embodiments of the antibody-drug conjugate of the formula (Id), (Id1) or (Id2), the multi-chain antibody is an anti-C10orf54 antibody, optionally a humanized anti-C10orf54 antibody.

In certain embodiments of the antibody-drug conjugate of the formula (Id), (Id1) or (Id2), the first cysteine residue is from a heavy chain and the second cysteine residue is from a light chain of the multi-chain antibody.

In certain embodiments of the antibody-drug conjugate of formula the formula (Id), (Id1) or (Id2), the first and second cysteine residues are from the same heavy chain of the multi-chain antibody.

In certain embodiments of the antibody-drug conjugate of formula (Id), the antibody-drug conjugate is of the following formula:

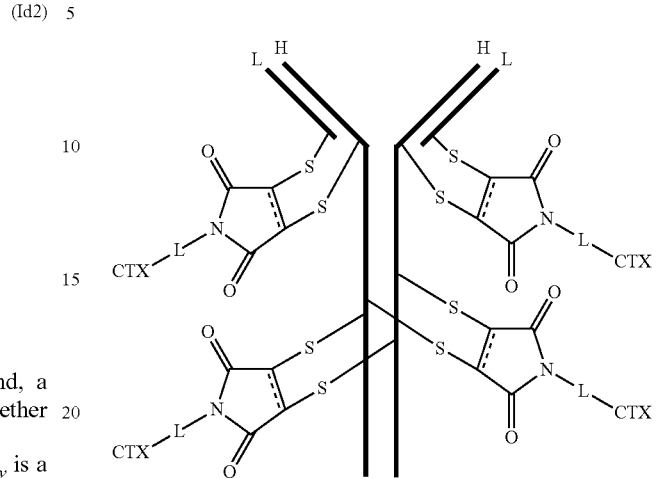

where each heavy chain of the multi-chain antibody is denoted by the letter H, and each light chain of the multi-chain antibody is denoted by the letter L; and the ----- bond represents a single or a double bond.

In certain embodiments of the antibody-drug conjugate of formula (Id), the antibody-drug conjugate is of the following formula:

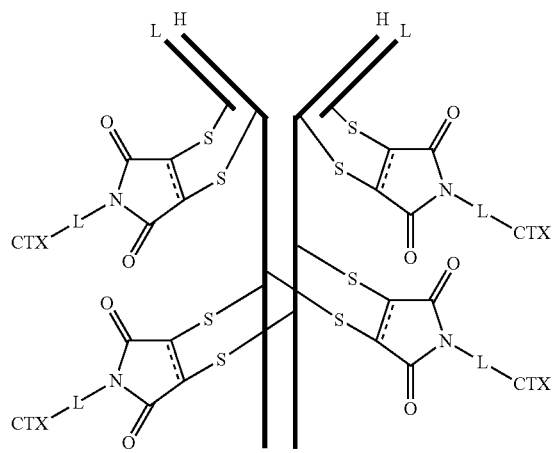

where each heavy chain of the multi-chain antibody is denoted by the letter H, and each light chain of the multi-chain antibody is denoted by the letter L; and the ----- bond represents a single or a double bond.

In certain embodiments of the antibody-drug conjugate of formula (Id1), the antibody-drug conjugate is of the following formula:

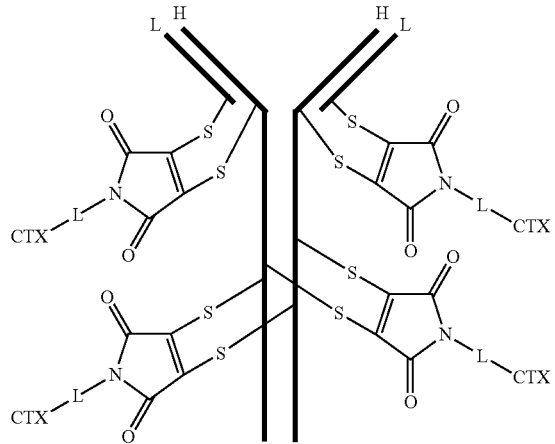

where each heavy chain of the multi-chain antibody is denoted by the letter H, and each light chain of the multi-chain antibody is denoted by the letter L.

In certain embodiments of the antibody-drug conjugate of formula (Id1), the antibody-drug conjugate is of the following formula:

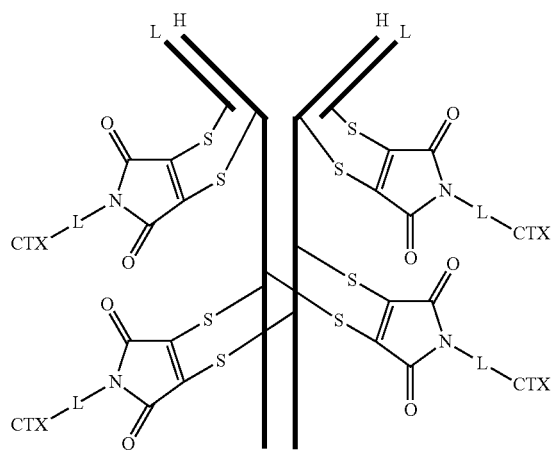

where each heavy chain of the multi-chain antibody is denoted by the letter H, and each light chain of the multi-chain antibody is denoted by the letter L.

In certain embodiments of the antibody-drug conjugate of formula (Id2), the antibody-drug conjugate is of the following formula:

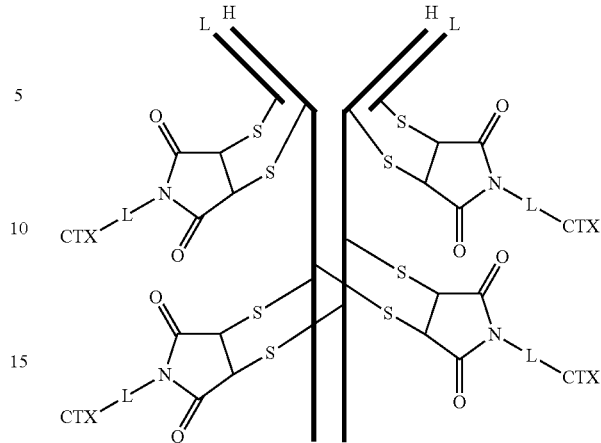

where each heavy chain of the multi-chain antibody is denoted by the letter H, and each light chain of the multi-chain antibody is denoted by the letter L.

In certain embodiments of the antibody-drug conjugate of formula (Id2), the antibody-drug conjugate is of the following formula:

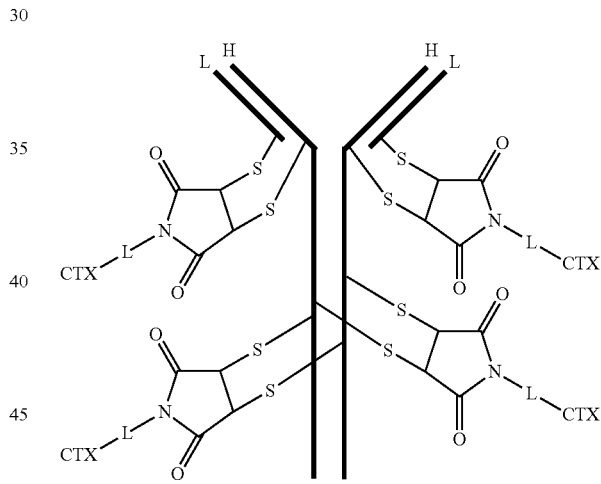

where each heavy chain of the multi-chain antibody is denoted by the letter H, and each light chain of the multi-chain antibody is denoted by the letter L.

In certain embodiments of the antibody-drug conjugate of the formula (Id), (Id1) or (Id2), the multi-chain antibody comprises mutations in one or more cysteines in the hinge regions of two heavy chains. In certain embodiments, the one or more cysteine residues are mutated to structurally related amino acids. In certain embodiments, the one or more cysteine residues are mutated to alanines.

In certain embodiments of the antibody-drug conjugate of formula (Id), wherein the multi-chain antibody comprises mutations in one or more cysteines in the hinge regions of two heavy chains, the antibody-drug conjugate is of the following formula:

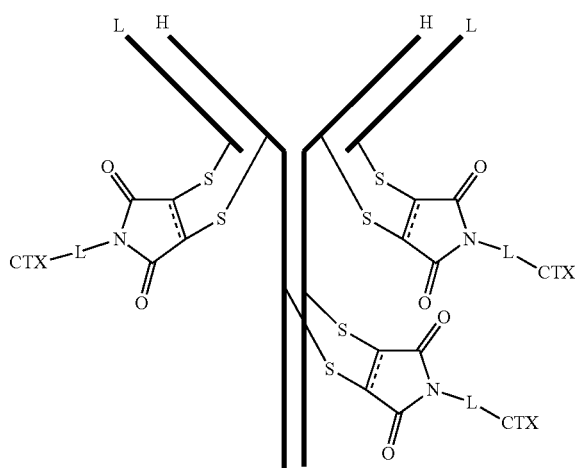

where each heavy chain of the multi-chain antibody is denoted by the letter H, and each light chain of the multi-chain antibody is denoted by the letter L; and the ----- bond represents a single or a double bond. For the embodiments of the antibody-drug conjugate of formula (Id) depicted above, the ADC has a DAR=3 (three drugs per antibody). As described herein, such ADCs may be prepared, as described herein, by mutating one or more of the hinge cysteine residues of a human IgG1 (e.g., 1 hinge cysteine), IgG2 (e.g., 3 hinge cysteines), IgG3 (e.g., 10 hinge cysteines), or IgG4 (e.g., 1 hinge cysteine).

In certain embodiments of the antibody-drug conjugate of formula (Id), wherein the multi-chain antibody comprises mutations in one or more cysteines in the hinge regions of two heavy chains, the antibody-drug conjugate is of the following formula:

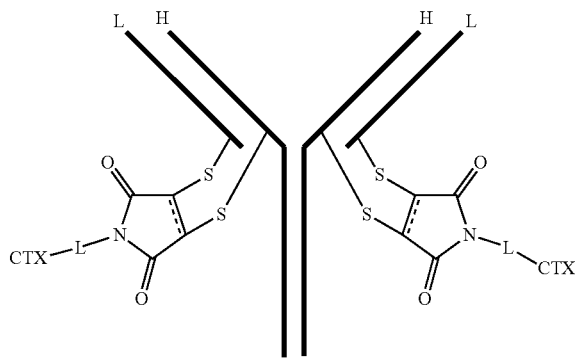

where each heavy chain of the multi-chain antibody is denoted by the letter H, and each light chain of the multi-chain antibody is denoted by the letter L; and the ----- bond represents a single or a double bond. For the embodiments of the antibody-drug conjugate of formula (Id) depicted above, the ADC has a DAR=2 (two drugs per antibody). As described herein, such ADCs may be prepared by mutating one or more of the hinge cysteine residues of a human IgG1 (e.g., 2 hinge cysteines), IgG2 (e.g., 4 hinge cysteines), IgG3 (e.g., 11 hinge cysteines), or IgG4 (e.g., 2 hinge cysteines). In certain embodiments of the antibody-drug conjugate of formula (Id), L is a noncleavable linker.

In certain embodiments of the antibody-drug conjugate of formula (Id1), wherein the multi-chain antibody comprises mutations in one or more cysteines in the hinge regions of two heavy chains, the antibody-drug conjugate is of the following formula:

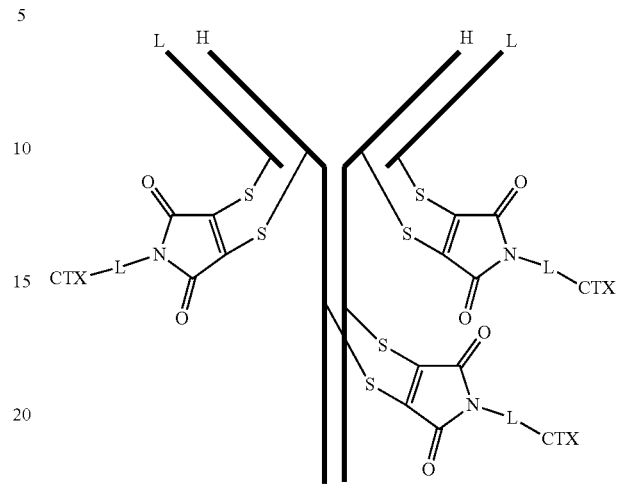

where each heavy chain of the multi-chain antibody is denoted by the letter H, and each light chain of the multi-chain antibody is denoted by the letter L. For the embodiments of the antibody-drug conjugate of formula (Id1) depicted above, the ADC has a DAR=3 (three drugs per antibody). As described herein, such ADCs may be prepared by mutating one or more of the hinge cysteine residues of a human IgG1 (e.g., 1 hinge cysteine), IgG2 (e.g., 3 hinge cysteines), IgG3 (e.g., 10 hinge cysteines), or IgG4 (e.g., 1 hinge cysteine).

In certain embodiments of the antibody-drug conjugate of formula (Id1), wherein the multi-chain antibody comprises mutations in one or more cysteines in the hinge regions of two heavy chains, the antibody-drug conjugate is of the following formula:

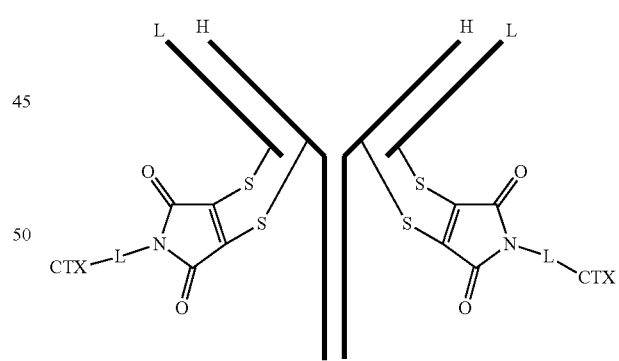

where each heavy chain of the multi-chain antibody is denoted by the letter H, and each light chain of the multi-chain antibody is denoted by the letter L. For the embodiments of the antibody-drug conjugate of formula (Id1) depicted above, the ADC has a DAR=2 (two drugs per antibody). As described herein, such ADCs may be prepared by mutating one or more of the hinge cysteine residues of a human IgG1 (e.g., 2 hinge cysteines), IgG2 (e.g., 4 hinge cysteines), IgG3 (e.g., 11 hinge cysteines), or IgG4 (e.g., 2 hinge cysteines). In certain embodiments of the antibody-drug conjugate of formula (Id1), L is a noncleavable linker.

In certain embodiments of the antibody-drug conjugate of formula (Id2), wherein the multi-chain antibody comprises mutations in one or more cysteines in the hinge regions of two heavy chains, the antibody-drug conjugate is of the following formula:

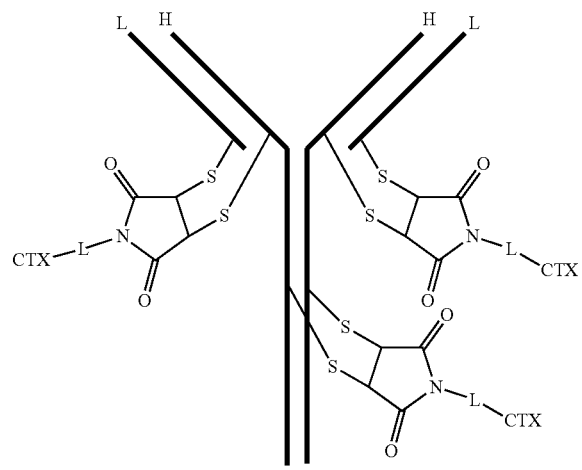

where each heavy chain of the multi-chain antibody is denoted by the letter H, and each light chain of the multi-chain antibody is denoted by the letter L. For the embodiments of the antibody-drug conjugate of formula (Id2) depicted above, the ADC has a DAR=3 (three drugs per antibody). As described herein, such ADCs may be prepared by mutating one or more of the hinge cysteine residues of a human IgG1 (e.g., 1 hinge cysteine), IgG2 (e.g., 3 hinge cysteines), IgG3 (e.g., 10 hinge cysteines), or IgG4 (e.g., 1 hinge cysteine).

In certain embodiments of the antibody-drug conjugate of formula (Id2), wherein the multi-chain antibody comprises mutations in one or more cysteines in the hinge regions of two heavy chains, the antibody-drug conjugate is of the following formula:

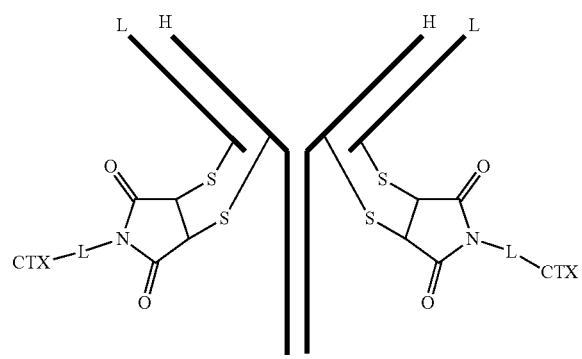

where each heavy chain of the multi-chain antibody is denoted by the letter H, and each light chain of the multi-chain antibody is denoted by the letter L. For the embodiments of the antibody-drug conjugate of formula (Id2) depicted above, the ADC has a DAR=2 (two drugs per antibody). As described herein, such ADCs may be prepared by mutating one or more of the hinge cysteine residues of a human IgG1 (e.g., 2 hinge cysteines), IgG2 (e.g., 4 hinge cysteines), IgG3 (e.g., 11 hinge cysteines), or IgG4 (e.g., 2 hinge cysteines). In certain embodiments of the antibody-drug conjugate of formula (Id2), L is a noncleavable linker.

In certain embodiments of the antibody-drug conjugate of the formula (Id), (Id1) or (Id2), L is:

—$(CH_2)_mC(O)$—,

—$(CH_2CH_2O)_p(CH_2CH_2)C(O)$—, or

—$(CH_2CH_2)(OCH_2CH_2)_pC(O)$—;

wherein m is an integer of 5 to 11, and p is an integer of 1 to 3.

In certain embodiments of the antibody-drug conjugate of the formula (Id), (Id1) or (Id2), L is a cleavable linker.

In certain embodiments of the antibody-drug conjugate of the formula (Id), (Id1) or (Id2), L is:

—$(CH_2)_mC(O)$-Val-Ala-PAB-C(O)—,

—$(CH_2)_mC(O)$-Val-Cit-PAB-C(O)—,

—$(CH_2CH_2O)_p(CH_2CH_2)C(O)$-Val-Ala-PAB-C(O)—,

—$(CH_2CH_2O)_p(CH_2CH_2)C(O)$-Val-Cit-PAB-C(O)—,

—$(CH_2CH_2)(OCH_2CH_2)_pC(O)$-Val-Ala-PAB-C(O)—, or

—$(CH_2CH_2)(OCH_2CH_2)_pC(O)$-Val-Cit-PAB-C(O)—;

wherein m is an integer of 5 to 11, and p is an integer of 1 to 3; and wherein PAB has the following structure:

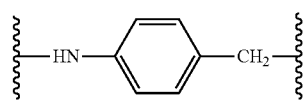

In certain embodiments of the antibody-drug conjugate of the formula (Id), (Id1) or (Id2), CTX is MMAF. In certain embodiments, the CTX is MMAE. In certain embodiments, the CTX is a PDB.

In certain embodiments of the antibody-drug conjugate of the formula (Id), (Id1) or (Id2), n is 2, 3, or 4.

In certain embodiments of the antibody-drug conjugate of the formula (Id), (Id1) or (Id2), CTX is MMAF, and L is —$(CH_2)_5C(O)$—. In certain embodiments, CTX is MMAE, and L is —$(CH_2)_5C(O)$-Val-Ala-PAB-O—C(O)—. In certain embodiments, CTX is a PBD, and L is —$(CH_2)_5C(O)$-Val-Ala-, —$(CH_2)_5C(O)$-Val-Cit-, —$(CH_2)_5C(O)$-Val-Ala-PAB-O—C(O)—, or —$(CH_2)_5C(O)$-Val-Cit-PAB-O—C(O)—.

Methods for Making ADCS

Methods for making ADCs include using the linker-cytotoxin conjugates and antibody hinge mutants.

An optional DAR (drugs-antibody ratio) is desirable for ADCs, including, for example, a DAR of 2, 3, or 4. For example, the following schemes illustrates general schemes for preparation of homogenous ADCs with DAR=2, 3, or 4, as disclosed herein, which may be made by the methods disclosed herein.

For example, for ADCs with IgG1 antibodies, one or both of the hinge cysteines may be mutated to another amino acid (e.g., alanine) to prepare ADC with a DAR of 3 or 2, respectively.

For example, for ADCs with IgG2 antibodies, two, three or four of the hinge cysteines may be mutated to another amino acid (e.g., alanine) to prepare ADC with a DAR of 4, 3 or 2, respectively.

For example, for ADCs with IgG3 antibodies, nine, ten or eleven of the hinge cysteines may be mutated to another amino acid (e.g., alanine) to prepare ADC with a DAR of 4, 3 or 2, respectively.

For another example, for ADCs with IgG4 antibodies, one or both of the hinge cysteines may be mutated to another amino acid (e.g., alanine) for prepare ADC with a DAR of 3 or 2, respectively.

Illustrative General Schemes for Preparation of ADCs with DAR=2 or 3:

A. Preparation of Hinge Mutants

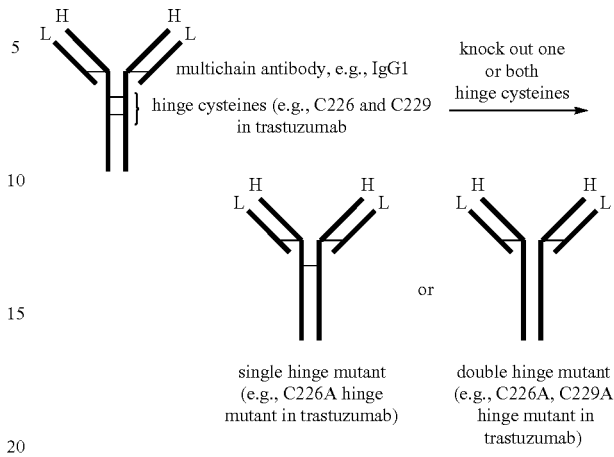

B. Conjugation

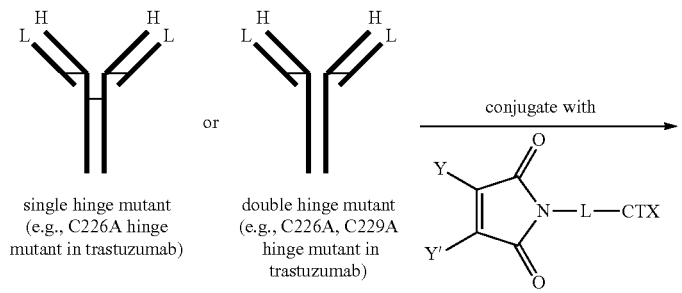

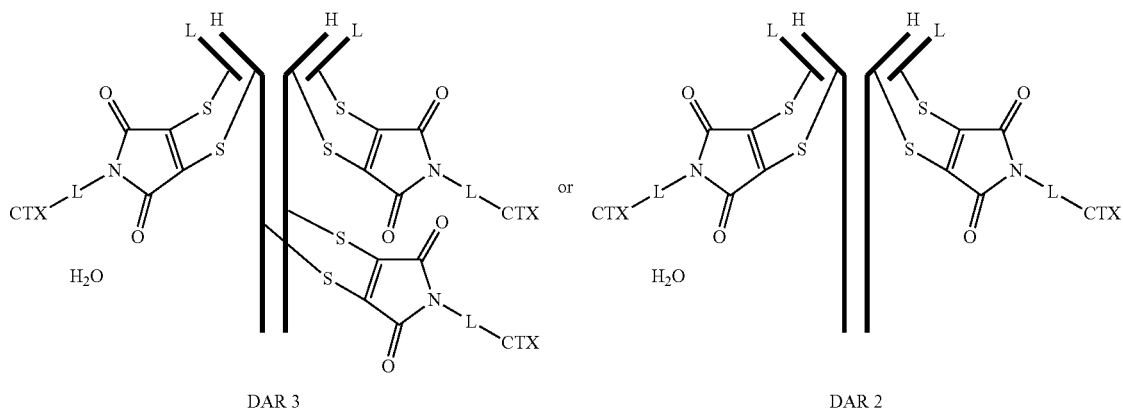

The hinge regions of the human IgG1 and IgG4 heavy chains contain two cysteine residues, whereas the hinge region of the human IgG3 heavy chains contains eleven cysteine residues, and the hinge region of the human IgG4 heavy chains contains four cysteine residues (see Table A).

TABLE A

Hinge sequences of human IgG1, IgG2, IgG3 and IgG4 antibodies (SEQ ID NOS 1925-1928, respectively, in order of appearance)

| Residue position | 216 | 217 | 218 | 219 | 220 | 221 | 222 | 223 | 224 | 225 | | 226 | 227 |
|---|---|---|---|---|---|---|---|---|---|---|---|---|---|
| Human IgG1 | E | P | K | S | C | D | K | T | H | T | | C | P |
| Human IgG2 | E | R | K | | | | | | | | | C | C |
| Human IgG3 | E | L | K | T | P | L | G | D | T | T | H | T | C | P |
| Human IgG4 | E | S | K | Y | G | P | P | | | | | C | p |

| Residue position | 228 | | | | | | | | | | | | |
|---|---|---|---|---|---|---|---|---|---|---|---|---|---|
| Human IgG1 | P | | | | | | | | | | | | |
| Human IgG2 | V | E | C | P | P | | | | | | | | |
| Human IgG3 | R | C | P | (E | P | K | S | C | D | T | P | P | P | C |
| Human IgG4 | S | | | | | | | | | | | | |

| Residue position | | | | 229 | 230 | 231 | 232 | 233 | 234 | 235 | 236 | 237 | 238 |
|---|---|---|---|---|---|---|---|---|---|---|---|---|---|
| Human IgG1 | | | | C | P | A | P | E | L | L | G | G | P |
| Human IgG2 | | | | C | P | A | P | P | V | A | G | | P |
| Human IgG3 | P | R | C | P)3 | | A | P | E | L | L | G | G | P |
| Human IgG4 | | | | | V | P | A | P | E | F | L | G | G | P |

The amino acid sequence of the hinge region and the N terminus of the CH2 domain are aligned against amino acids 216 to 238 of human IgG1 (Eu numbering; adapted from Burton DR (1985) Immunoglobulin G: functional sites. Mol Immunol 22: 161-206)

IgG hinge mutants were generated by mutating one or both cysteines in the hinge region to structurally related amino acids, for example, alanines. Hinge residues are numbered using human IgG1 Eu numbering (Burton D R (1985) Immunoglobulin G: functional sites. Mol Immunol 22: 161-206). Tables B-E provide the correspondence between the IMGT unique numbering for C-DOMAIN, the IMGT exon numbering, the Eu and Kabat numberings for human IgG1 (Table B), IgG2 (Table C), IgG3 (Table D) and IgG4 (Table E).

TABLE B

Human IgG1 (SEQ ID NO: 1929)

| IMGT numbering for the hinge | IGHG1 amino acid translation J00228 | IMGT exon numbering | Eu numbering [1](4) | Kabat numbering [2](4) |
|---|---|---|---|---|
| 1 | (E) | 1 | 216 | 226 |
| 2 | P | 2 | 217 | 227 |
| 3 | K | 3 | 218 | 228 |
| 4 | S | 4 | 219 | 232 |
| 5 | C | 5 | 220 | 233 |
| 6 | D | 6 | 221 | 234 |
| 7 | K | 7 | 222 | 235 |
| 8 | T | 8 | 223 | 236 |
| 9 | H | 9 | 224 | 237 |
| 10 | T | 10 | 225 | 238 |
| 11 | C | 11 | 226 | 239 |
| 12 | P | 12 | 227 | 240 |
| 13 | P | 13 | 228 | 241 |

TABLE B-continued

Human IgG1 (SEQ ID NO: 1929)

| IMGT numbering for the hinge | IGHG1 amino acid translation J00228 | IMGT exon numbering | Eu numbering [1](4) | Kabat numbering [2](4) |
|---|---|---|---|---|
| 14 | C | 14 | 229 | 242 |
| 15 | P | 15 | 230 | 243 |

TABLE C

Human IgG2 (SEQ ID NO: 1930)

| IMGT numbering for the hinge | IGHG2 amino acid translation J00230 | IMGT exon numbering | Eu numbering [1](4) | Kabat numbering [2](4) |
|---|---|---|---|---|
| 1 | (E) | 1 | 216 | 226 |
| 2 | R | 2 | 217 | 227 |
| 3 | K | 3 | 218 | 228 |
| 4 | C | 4 | 219 | 232 |
| 5 | C | 5 | 220 | 233 |
| 6 | V | 6 | 222 | 235 |
| 7 | E | 7 | 224 | 237 |
| 8 | C | 8 | 226 | 239 |
| 9 | P | 9 | 227 | 240 |
| 10 | P | 10 | 228 | 241 |
| 11 | C | 11 | 229 | 242 |
| 12 | P | 12 | 230 | 243 |

TABLE D

Human IgG3 (SEQ ID NOS 1931-1932, respectively, in order of appearance)

| | H1 | | | | | | H2 | |
|---|---|---|---|---|---|---|---|---|
| IMGT numbering for the hinge | IGHG3 amino acid translation X03604 | IMGT exon numbering | Eu numbering [1](4) | Kabat numbering [2](4) | IMGT numbering for the hinge | IGHG3 amino acid translation X03604 | IMGT exon numbering | Eu numbering [1] |
| 1 | (E) | 1 | 216 | 226 | 1 | (E) | 1 | — |
| 2 | L | 2 | 217 | 227 | 2 | P | 2 | — |
| 3 | K | 3 | 218 | 228 | 3 | K | 3 | — |
| 4 | T | 4 | — | 229 | 4 | S | 4 | — |
| 5 | P | 5 | — | 230 | 5 | C | 5 | — |
| 6 | L | 6 | 219 | 232 | 6 | D | 6 | — |
| 7 | G | 7 | 220 | 233 | 7 | T | 7 | — |
| 8 | D | 8 | 221 | 234 | 8 | P | 8 | — |
| 9 | T | 9 | 222 | 235 | 9 | P | 9 | — |
| 10 | T | 10 | 223 | 236 | 10 | P | 10 | — |
| 11 | H | 11 | 224 | 237 | 11 | C | 11 | — |
| 12 | T | 12 | 225 | 238 | 12 | P | 12 | — |
| 13 | C | 13 | 226 | 239 | 13 | R | 13 | — |
| 14 | P | 14 | 227 | 240 | 14 | C | 14 | — |
| 15 | R | 15 | 228 | 241 | 15 | P | 15 | — |
| 16 | C | 16 | — | 241A | 16 | — | — | — |
| 17 | P | 17 | — | 241B | 17 | — | — | — |

| IMGT numbering for the hinge | H2 Kabat numbering [2] | H3 IMGT exon numbering | Eu numbering [1] | Kabat numbering [2] | H4 IMGT exon numbering | Eu numbering [1] | Kabat numbering [2] |
|---|---|---|---|---|---|---|---|
| 1 | 241C | 1 | — | 241R | 1 | — | 241GG |
| 2 | 241D | 2 | — | 241S | 2 | — | 241HH |
| 3 | 241E | 3 | — | 241T | 3 | — | 241II |
| 4 | 241F | 4 | — | 241U | 4 | — | 241JJ |
| 5 | 241G | 5 | — | 241V | 5 | — | 241KK |
| 6 | 241H | 6 | — | 241W | 6 | — | 241LL |
| 7 | 241I | 7 | — | 241X | 7 | — | 241MM |
| 8 | 241J | 8 | — | 241Y | 8 | — | 241NN |
| 9 | 241K | 9 | — | 241Z | 9 | — | 241OO |
| 10 | 241L | 10 | — | 241AA | 10 | — | 241PP |
| 11 | 241M | 11 | — | 241BB | 11 | — | 241QQ |
| 12 | 241N | 12 | — | 241CC | 12 | — | 241RR |
| 13 | 241O | 13 | — | 241DD | 13 | — | 241SS |
| 14 | 241P | 14 | — | 241EE | 14 | 229 | 242 |
| 15 | 241Q | 15 | — | 241FF | 15 | 230 | 243 |
| 16 | — | — | — | — | — | — | — |
| 17 | — | — | — | — | — | — | — |

TABLE E

Human IgG4 (SEQ ID NO: 1933)

| IMGT numbering for the hinge | IGHG4 amino acid translation K01316 | IMGT exon numbering | Eu numbering [1] | Kabat numbering [2] |
|---|---|---|---|---|
| 1 | (E) | 1 | 216 | 226 |
| 2 | S | 2 | 217 | 227 |
| 3 | K | 3 | 218 | 228 |
| 4 | Y | 4 | — | 229 |
| 5 | G | 5 | — | 230 |
| 6 | P | 6 | 224 | 237 |
| 7 | P | 7 | 225 | 238 |
| 8 | C | 8 | 226 | 239 |
| 9 | P | 9 | 227 | 240 |
| 10 | S | 10 | 228 | 241 |
| 11 | C | 11 | 229 | 242 |
| 12 | P | 12 | 230 | 243 |

(1) J00228 corresponds to the IGHG1*01 allele (Alignment of alleles: Human IGHG1) and to a G1m1, 17 chain (G1m allotypes). The Eu gamma1 chain is encoded by the IGHG1*03 allele (CH1 K120 > R, CH3 D12 > E and L14 > M) and is a G1m3 chain (G1m allotypes).
(2) The IGHG1, IGHG3 and IGHG4 CH2 exons encode 110 amino acids. The IGHG2 CH2 exon encodes 109 amino acids, due to a 3 nt deletion corresponding to codon 3 (position 1.4 in the IMGT unique numbering for C-DOMAINs).
(3) The last two amino acids of the IGHG CH3 exons belong to the CHS which encodes the heavy chain C-terminus found in the secreted immunoglobulins.
(4) In Kabat [2], Eu index from 219 to 221 should have been aligned with the Eu protein (pp. 671). As a consequence, Kabat positions 232, 233 and 234 correspond to Eu index positions 219, 220 and 221, respectively (pp. 670-678).
(5) MGT labels (concepts of description) are written in capital letters.

References:
[1] Edelman, G. M. et al., Proc. Natl. Acad. USA, 63, 78-85 (1969). PMID: 5257969
[2] Kabat, E. A. et al., Sequences of proteins of immunological interest. 5th Edition - US Department of Health and Human Services, NIH publication no 91-3242, pp 662, 680, 689 (1991).

Linker-Cytotoxin Conjugates

In another aspect, provided herein for use with the antibodies described herein are linker-cytotoxin conjugates of the following formulas (IIa), (IIb) an (IIc):

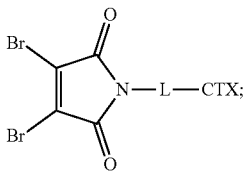
(IIa)

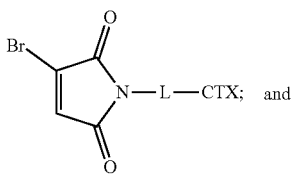
(IIb)
and

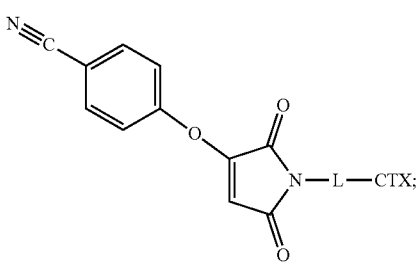
(IIc)

or an enantiomer, diasteriomer, or mixtures thereof;
wherein:
L is a cleavable or noncleavable linker; and
CTX is cytotoxin bonded to L by an amide bond or a carbamate bond.

In certain embodiments of the linker-cytotoxin conjugate of the formula (IIa), (IIb), or (IIc), L is a noncleavable linker.

In certain embodiments of the linker-cytotoxin conjugate of the formula (IIa), (IIb), or (IIc), L is:

—(CH$_2$)$_m$C(O)—,

—(CH$_2$CH$_2$O)$_p$(CH$_2$CH$_2$)C(O)—, or

—(CH$_2$CH$_2$)(OCH$_2$CH$_2$)$_p$C(O)—;

wherein m is an integer of 5 to 11, and p is an integer of 1 to 3.

In certain embodiments of the linker-cytotoxin conjugate of the formula (IIa), (IIb), or (IIc), L is a cleavable linker.

In certain embodiments of the linker-cytotoxin conjugate of the formula (IIa), (IIb), or (IIc), L is:

—(CH$_2$)$_m$C(O)-Val-Ala-PAB-C(O)—,

—(CH$_2$)$_m$C(O)-Val-Cit-PAB-C(O)—,

—(CH$_2$CH$_2$O)$_p$(CH$_2$CH$_2$)C(O)-Val-Ala-PAB-C(O)—,

—(CH$_2$CH$_2$O)$_p$(CH$_2$CH$_2$)C(O)-Val-Cit-PAB-C(O)—,

—(CH$_2$CH$_2$)(OCH$_2$CH$_2$)$_p$C(O)-Val-Ala-PAB-C(O)—, or

—(CH$_2$CH$_2$)(OCH$_2$CH$_2$)$_p$C(O)-Val-Cit-PAB-C(O)—;

wherein m is an integer of 5 to 11, and p is an integer of 1 to 3; and
wherein PAB has the following structure:

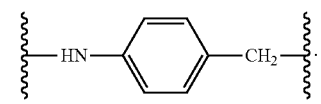

In certain embodiments of the linker-cytotoxin conjugate of the formula (IIa), (IIb), or (IIc), the CTX is an auristatin. In certain embodiments, the CTX is MMAF. In certain embodiments the CTX is MMAE. In certain embodiments, the CTX is a PBD. In certain embodiments, the CTX is a calicheamicin, doxorubicin, camptothecin, duocarmycin, DM1, DM4, a maytansinoid, or a tubulysin.

In certain embodiments of the linker-cytotoxin conjugate of formula (IIa), (IIb) or (IIc), where CTX is MMAE, L is a cleavable linker.

In certain embodiments of the linker-cytotoxin conjugate of formula (IIa), (IIb) or (IIc), where CTX is MMAE, L is —(CH$_2$)$_m$C(O)-Val-Ala-PAB-O—C(O)—, or —(CH$_2$)$_m$C(O)-Val-Cit-PAB-O—C(O)—, wherein m is an integer of 5 to 11.

In certain embodiments of the linker-cytotoxin conjugate of formula (IIa), (IIb) or (IIc), where CTX is MMAE, L is —(CH$_2$)$_5$C(O)-Val-Ala-PAB-O—C(O)—, or —(CH$_2$)$_5$C(O)-Val-Cit-PAB-O—C(O)—.

In certain embodiments of the linker-cytotoxin conjugate of formula (IIa), (IIb) or (IIc), where CTX is a PBD, L is a cleavable linker.

In certain embodiments of the linker-cytotoxin conjugate of formula (IIa), (IIb) or (IIc), where CTX is a PBD, L is —(CH$_2$)$_m$C(O)-Val-Ala-PAB-O—C(O)—, or —(CH$_2$)$_m$C(O)-Val-Cit-PAB-O—C(O)—, wherein m is an integer of 5 to 11.

In certain embodiments of the linker-cytotoxin conjugate of formula (IIa), (IIb) or (IIc), where CTX is a PBD, L is —(CH$_2$)$_5$C(O)-Val-Ala-PAB-O—C(O)—, or —(CH$_2$)$_5$C(O)-Val-Cit-PAB-O—C(O)—.

In certain embodiments, the linker-cytotoxin conjugate has the following structure:

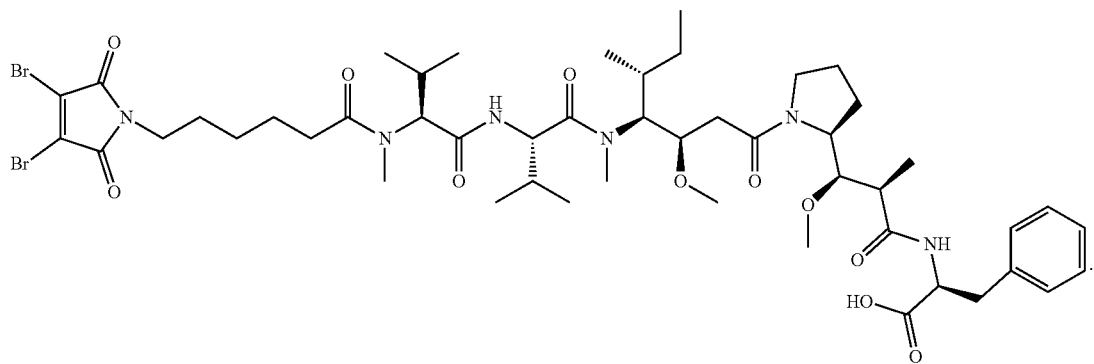 [SMILES: CC[C@@H](C)[C@@H]([C@@H](CC(=O)N1CCC[C@H]1[C@H](OC)[C@@H](C)C(=O)N[C@@H](Cc1ccccc1)C(=O)O)OC)N(C)C(=O)[C@@H](NC(=O)[C@H](C(C)C)N(C)C(=O)CCCCCN1C(=O)C(Br)=C(Br)C1=O)C(C)C]
In certain embodiments, the linker-cytotoxin conjugate has the following structure:
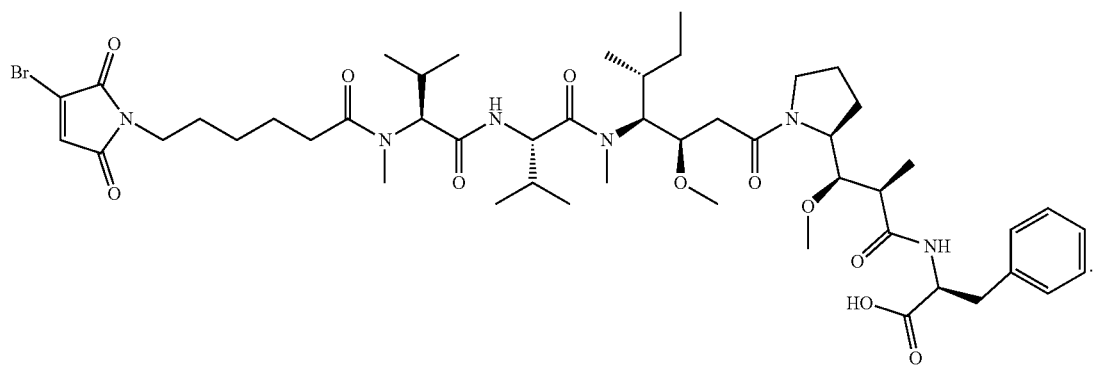 [SMILES: CC[C@@H](C)[C@@H]([C@@H](CC(=O)N1CCC[C@H]1[C@H](OC)[C@@H](C)C(=O)N[C@@H](Cc1ccccc1)C(=O)O)OC)N(C)C(=O)[C@@H](NC(=O)[C@H](C(C)C)N(C)C(=O)CCCCCN1C(=O)C=C(Br)C1=O)C(C)C]
In certain embodiments, the linker-cytotoxin conjugate has the following structure:
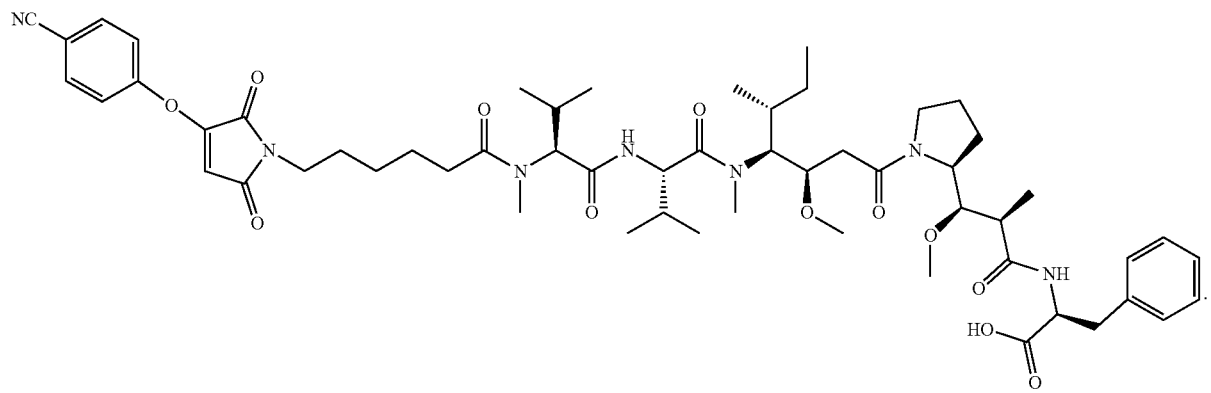 [SMILES: CC[C@@H](C)[C@@H]([C@@H](CC(=O)N1CCC[C@H]1[C@H](OC)[C@@H](C)C(=O)N[C@@H](Cc1ccccc1)C(=O)O)OC)N(C)C(=O)[C@@H](NC(=O)[C@H](C(C)C)N(C)C(=O)CCCCCN1C(=O)C=C(Oc2ccc(C#N)cc2)C1=O)C(C)C]

In certain embodiments, the linker-cytotoxin conjugate has the following structure:
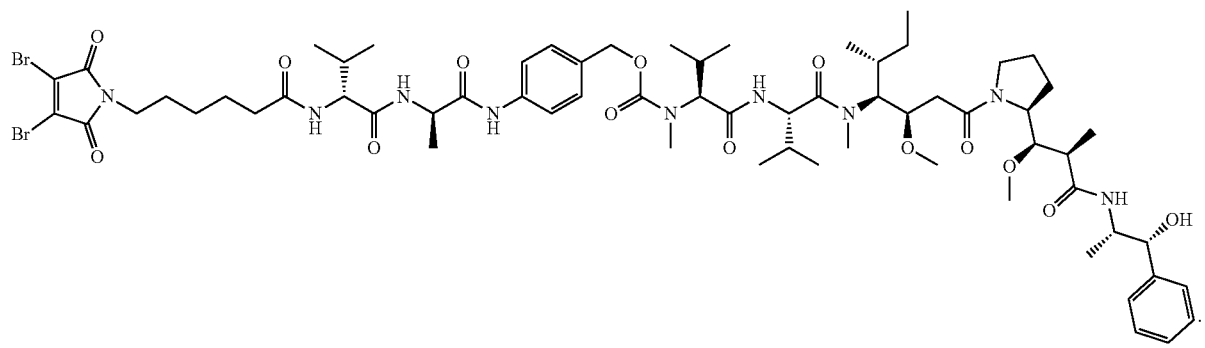 [SMILES: CC[C@@H](C)[C@@H]([C@@H](CC(=O)N1CCC[C@H]1[C@H](OC)[C@@H](C)C(=O)N[C@@H](C)[C@H](O)c1ccccc1)OC)N(C)C(=O)[C@@H](NC(=O)[C@H](C(C)C)N(C)C(=O)OCc1ccc(NC(=O)[C@@H](C)NC(=O)[C@H](NC(=O)CCCCCN2C(=O)C(Br)=C(Br)C2=O)C(C)C)cc1)C(C)C]
In certain embodiments, the linker-cytotoxin conjugate has the following structure:
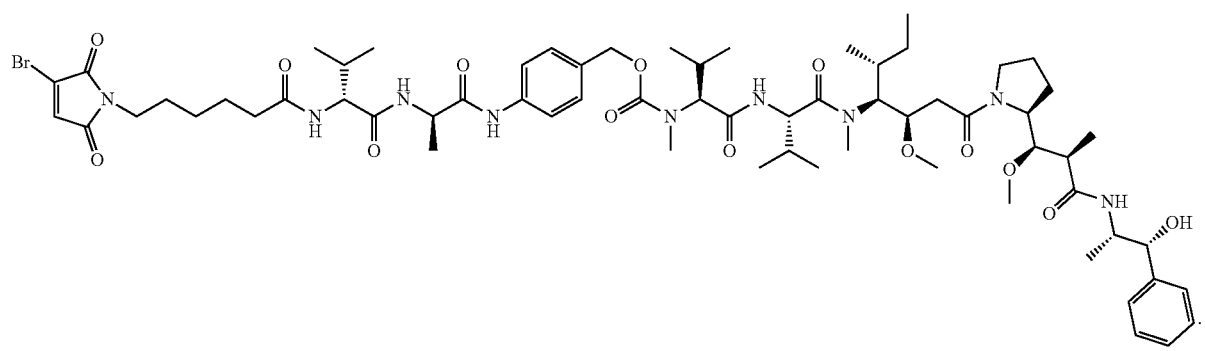 [SMILES: CC[C@@H](C)[C@@H]([C@@H](CC(=O)N1CCC[C@H]1[C@H](OC)[C@@H](C)C(=O)N[C@@H](C)[C@H](O)c1ccccc1)OC)N(C)C(=O)[C@@H](NC(=O)[C@H](C(C)C)N(C)C(=O)OCc1ccc(NC(=O)[C@@H](C)NC(=O)[C@H](NC(=O)CCCCCN2C(=O)C=C(Br)C2=O)C(C)C)cc1)C(C)C]
In certain embodiments, the linker-cytotoxin conjugate has the following structure:
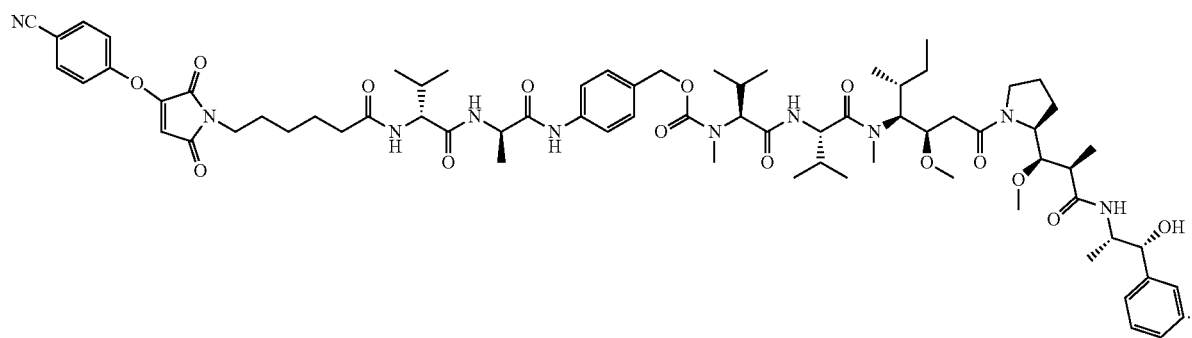 [SMILES: CC[C@@H](C)[C@@H]([C@@H](CC(=O)N1CCC[C@H]1[C@H](OC)[C@@H](C)C(=O)N[C@@H](C)[C@H](O)c1ccccc1)OC)N(C)C(=O)[C@@H](NC(=O)[C@H](C(C)C)N(C)C(=O)OCc1ccc(NC(=O)[C@@H](C)NC(=O)[C@H](NC(=O)CCCCCN2C(=O)C=C(Oc3ccc(C#N)cc3)C2=O)C(C)C)cc1)C(C)C]

In certain embodiments, the linker-cytotoxin conjugate has one of the following structures:
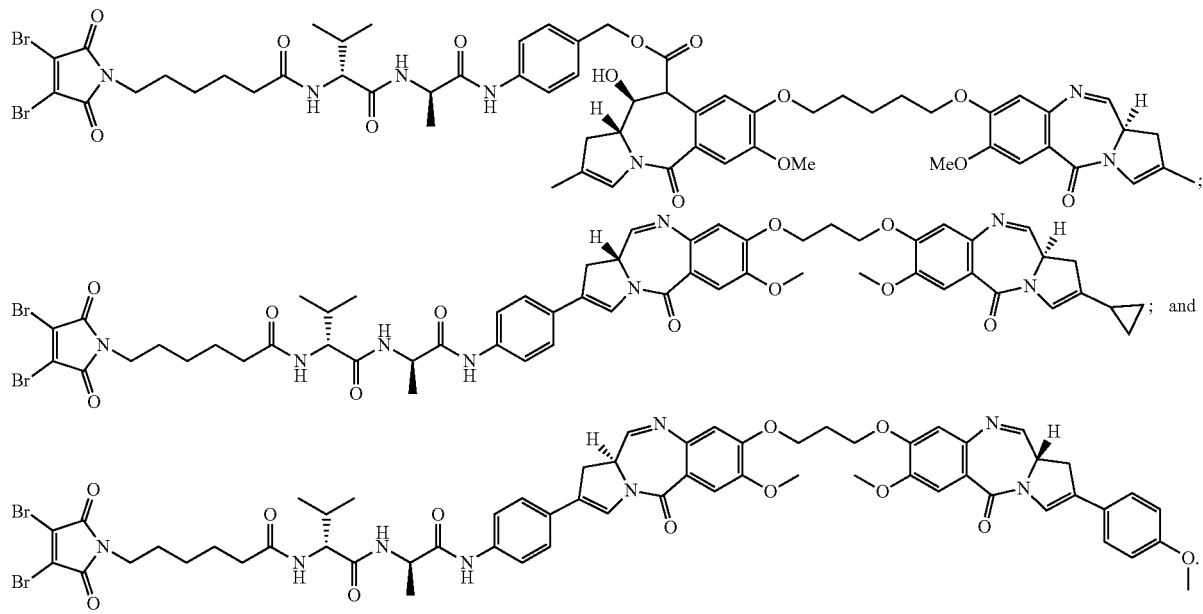
In certain embodiments, the linker-cytotoxin conjugate has one of the following structures:
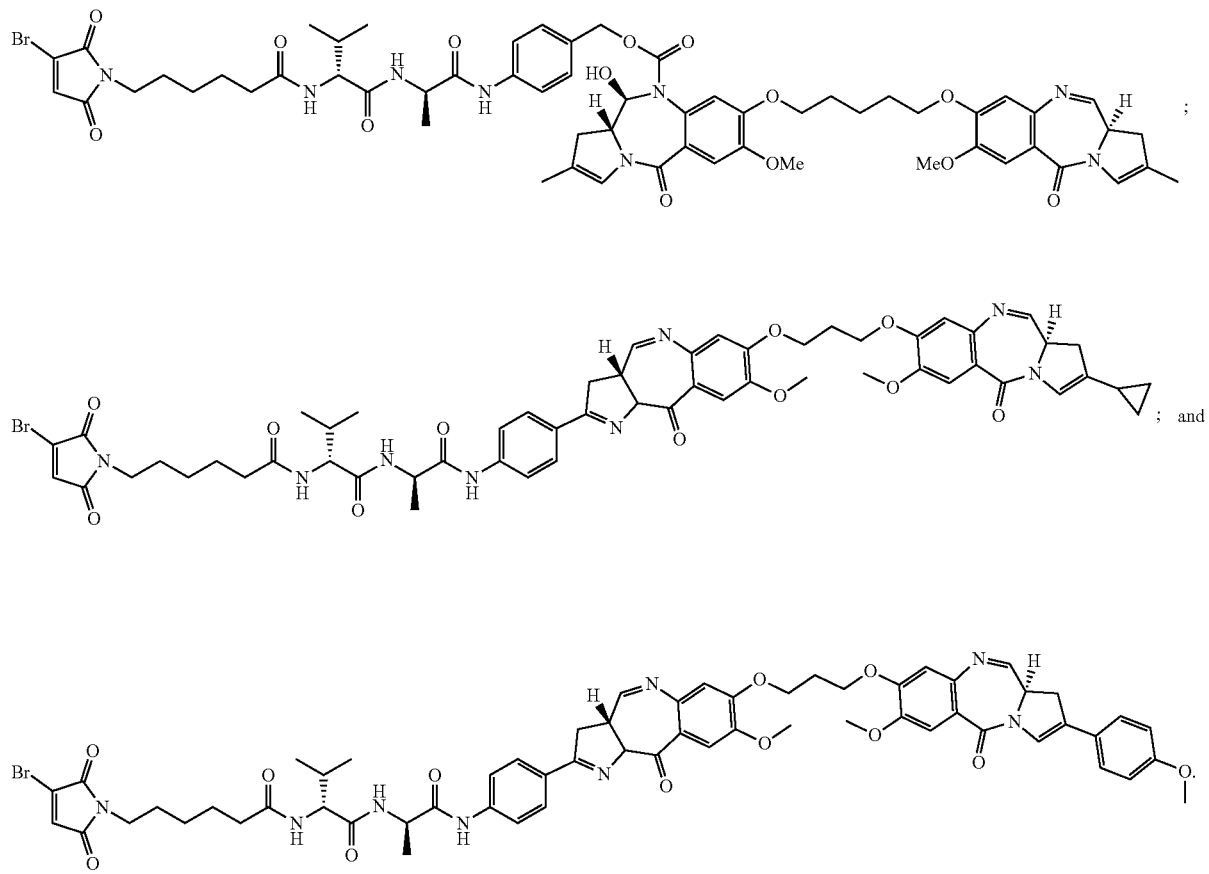

In certain embodiments, the linker-cytotoxin conjugate has one of the following structures:

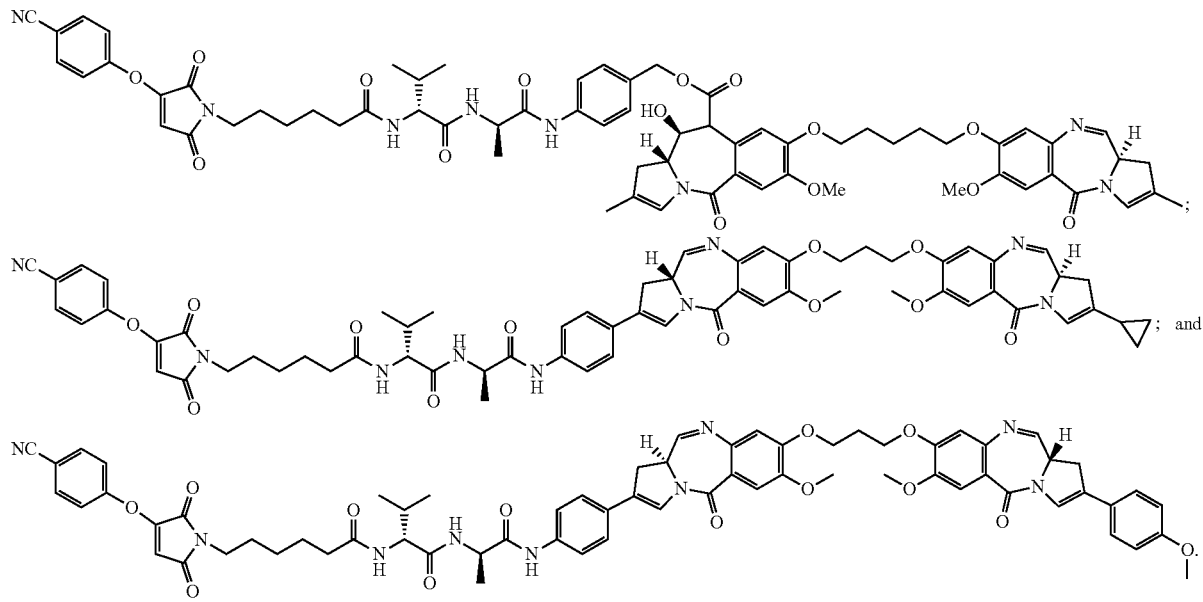

Pharmaceutical Compositions

Therapeutic formulations containing one or more of the antibodies provided herein can be prepared for storage by mixing the antibody having the desired degree of purity with optional physiologically acceptable carriers, excipients or stabilizers (*Remington's Pharmaceutical Sciences* (1990) Mack Publishing Co., Easton, Pa.), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

The antibodies provided herein can also, for example, be formulated in liposomes. Liposomes containing the molecule of interest are prepared by methods known in the art, such as described in Epstein et al. (1985) *Proc. Natl. Acad. Sci. USA* 82:3688; Hwang et al. (1980) *Proc. Natl. Acad. Sci. USA* 77:4030; and U.S. Pat. Nos. 4,485,045 and 4,544,545. Liposomes with enhanced circulation time are disclosed in U.S. Pat. No. 5,013,556.

Particularly useful immunoliposomes can be generated by the reverse phase evaporation method with a lipid composition containing phosphatidylcholine, cholesterol and PEG-derivatized phosphatidylethanolamine (PEG-PE). Liposomes are extruded through filters of defined pore size to yield liposomes with the desired diameter. Fab' fragments of an antibody provided herein can be conjugated to the liposomes as described in Martin et al. (1982) *J. Biol. Chem.* 257:286-288 via a disulfide interchange reaction. A chemotherapeutic agent (such as Doxorubicin) is optionally contained within the liposome; See Gabizon et al., (1989) *J. National Cancer Inst.* 81(19):1484.

Formulations, such as those described herein, can also contain more than one active compound as necessary for the particular indication being treated. In certain embodiments, formulations comprise an antibody provided herein and one or more active compounds with complementary activities that do not adversely affect each other. Such molecules are suitably present in combination in amounts that are effective for the purpose intended. For example, an antibody provided herein can be combined with one or more other therapeutic agents. Such combined therapy can be administered to the patient serially or simultaneously or in sequence.

An antibody provided herein can also be entrapped in microcapsule prepared, for example, by coacervation techniques or by interfacial polymerization, for example, hydroxymethylcellulose or gelatin-microcapsule and poly-(methylmethacylate) microcapsule, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* (1990) Mack Publishing Co., Easton, Pa.

The formulations to be used for in vivo administration can be sterile. This is readily accomplished by filtration through, e.g., sterile filtration membranes.

Sustained-release preparations can also be prepared. Suitable examples of sustained-release preparations include semipermeable matrices of solid hydrophobic polymers containing the polypeptide, which matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

In some embodiments, the pharmaceutical compositions provided herein contain therapeutically effective amounts of one or more of the antibodies provided herein, and optionally one or more additional prophylactic of therapeutic agents, in a pharmaceutically acceptable carrier. Such pharmaceutical compositions are useful in the prevention, treatment, or alleviation of one or more symptom of a C10orf54-mediated disease.

Pharmaceutical carriers suitable for administration of the compounds provided herein include any such carriers known to those skilled in the art to be suitable for the particular mode of administration.

In addition, the antibodies provided herein may be formulated as the sole pharmaceutically active ingredient in the composition or may be combined with other active ingredients (such as one or more other prophylactic or therapeutic agents).

The compositions can contain one or more antibodies provided herein. In one embodiment, the antibodies are formulated into suitable pharmaceutical preparations, such as solutions, suspensions, tablets, dispersible tablets, pills, capsules, powders, sustained release formulations or elixirs, for oral administration or in sterile solutions or suspensions for parenteral administration, as well as transdermal patch preparation and dry powder inhalers. In one embodiment, the antibodies described above are formulated into pharmaceutical compositions using techniques and procedures well known in the art (see, e.g., Ansel (1985) *Introduction to Pharmaceutical Dosage Forms*, 4$^{th}$ Ed., p. 126).

In certain embodiments of the compositions, effective concentrations of one or more antibodies or derivatives thereof is (are) mixed with a suitable pharmaceutical carrier. In specific embodiments, concentrations of the compounds in the compositions are effective for delivery of an amount, upon administration, that treats, prevents, or ameliorates a C10orf54-mediated disease or symptom thereof.

In one embodiment, the compositions are formulated for single dosage administration. To formulate a composition, the weight fraction of compound is dissolved, suspended, dispersed or otherwise mixed in a selected carrier at an effective concentration such that the treated condition is relieved, prevented, or one or more symptoms are ameliorated.

In some embodiments, the antibody provided herein is included in the pharmaceutically acceptable carrier in an effective amount sufficient to exert a therapeutically useful effect in the absence of undesirable side effects on the patient treated. The therapeutically effective concentration can be determined empirically by testing the compounds in in vitro and in vivo systems using routine methods and then extrapolated therefrom for dosages for humans.

The concentration of antibody in the pharmaceutical composition will depend on, e.g., the physicochemical characteristics of the antibody, the dosage schedule, and amount administered as well as other factors known to those of skill in the art.

In one embodiment, a therapeutically effective dosage produces a serum concentration of antibody of from about 0.1 ng/ml to about 50-100 µg/ml. The pharmaceutical compositions, in another embodiment, provide a dosage of from about 0.001 mg to about 2000 mg of antibody per kilogram of body weight per day. Pharmaceutical dosage unit forms can be prepared to provide from about 0.01 mg, 0.1 mg or 1 mg to about 500 mg, 1000 mg or 2000 mg, and in one embodiment from about 10 mg to about 500 mg of the antibody and/or a combination of other optional essential ingredients per dosage unit form.

The antibody can be administered at once, or may be divided into a number of smaller doses to be administered at intervals of time. It is understood that the precise dosage and duration of treatment is a function of the disease being treated and can be determined empirically using known testing protocols or by extrapolation from in vivo or in vitro test data. It is to be noted that concentrations and dosage values can also vary with the severity of the condition to be alleviated. It is to be further understood that for any particular subject, specific dosage regimens can be adjusted over time according to the individual need and the professional judgment of the person administering or supervising the administration of the compositions, and that the concentration ranges set forth herein are exemplary only and are not intended to limit the scope or practice of the claimed compositions.

Upon mixing or addition of the antibody, the resulting mixture can be a solution, suspension, emulsion or the like. The form of the resulting mixture depends upon a number of factors, including the intended mode of administration and the solubility of the compound in the selected carrier or vehicle. The effective concentration is sufficient for ameliorating the symptoms of the disease, disorder or condition treated and may be empirically determined.

In some embodiments, the pharmaceutical compositions are provided for administration to humans and animals in unit dosage forms, such as tablets, capsules, pills, powders, granules, sterile parenteral solutions or suspensions, and oral solutions or suspensions, and oil-water emulsions containing suitable quantities of the compounds or pharmaceutically acceptable derivatives thereof. The antibody is, in one embodiment, formulated and administered in unit-dosage forms or multiple-dosage forms. "Unit-dose" forms as used herein refers to physically discrete units suitable for human and animal subjects and packaged individually as is known in the art. Each unit-dose contains a predetermined quantity of the antibody sufficient to produce the desired therapeutic effect, in association with the required pharmaceutical carrier, vehicle or diluent. Examples of unit-dose forms include ampoules and syringes and individually packaged tablets or capsules. Unit-dose forms can be administered in fractions or multiples thereof. A "multiple-dose" form is a plurality of identical unit-dosage forms packaged in a single container to be administered in segregated unit-dose form. Examples of multiple-dose forms include vials, bottles of tablets or capsules or bottles of pints or gallons. Hence, multiple dose form is a multiple of unit-doses which are not segregated in packaging.

In specific embodiments, one or more anti-C10orf54 antibodies provided herein are in a liquid pharmaceutical formulation. Liquid pharmaceutically administrable compositions can, for example, be prepared by dissolving, dispersing, or otherwise mixing an active compound as defined above and optional pharmaceutical adjuvants in a carrier, such as, for example, water, saline, aqueous dextrose, glycerol, glycols, ethanol, and the like, to thereby form a solution or suspension. If desired, the pharmaceutical composition to be administered can also contain minor amounts of nontoxic auxiliary substances such as wetting agents, emulsifying agents, solubilizing agents, pH buffering agents and the like, for example, acetate, sodium citrate, cyclodextrine derivatives, sorbitan monolaurate, triethanolamine sodium acetate, triethanolamine oleate, and other such agents.

Actual methods of preparing such dosage forms are known, or will be apparent, to those skilled in this art; for example, see *Remington's Pharmaceutical Sciences* (1990) Mack Publishing Co., Easton, Pa.

Dosage forms or compositions containing antibody in the range of 0.005% to 100% with the balance made up from non-toxic carrier can be prepared. Methods for preparation of these compositions are known to those skilled in the art.

Oral pharmaceutical dosage forms are either solid, gel or liquid. The solid dosage forms include tablets, capsules, granules, and bulk powders. Types of oral tablets include compressed, chewable lozenges and tablets which may be enteric-coated, sugar-coated or film-coated. Capsules can be hard or soft gelatin capsules, while granules and powders can be provided in non-effervescent or effervescent form with the combination of other ingredients known to those skilled in the art.

In certain embodiments, the formulations are solid dosage forms. In certain embodiments, the formulations are capsules or tablets. The tablets, pills, capsules, troches and the like can contain one or more of the following ingredients, or compounds of a similar nature: a binder; a lubricant; a diluent; a glidant; a disintegrating agent; a coloring agent; a sweetening agent; a flavoring agent; a wetting agent; an emetic coating; and a film coating. Examples of binders include microcrystalline cellulose, gum tragacanth, glucose solution, acacia mucilage, gelatin solution, molasses, polvinylpyrrolidine, povidone, crospovidones, sucrose and starch paste. Lubricants include talc, starch, magnesium or calcium stearate, lycopodium and stearic acid. Diluents include, for example, lactose, sucrose, starch, kaolin, salt, mannitol and dicalcium phosphate. Glidants include, but are not limited to, colloidal silicon dioxide. Disintegrating agents include crosscarmellose sodium, sodium starch glycolate, alginic acid, corn starch, potato starch, bentonite, methylcellulose, agar and carboxymethylcellulose. Coloring agents include, for example, any of the approved certified water soluble FD and C dyes, mixtures thereof; and water insoluble FD and C dyes suspended on alumina hydrate. Sweetening agents include sucrose, lactose, mannitol and artificial sweetening agents such as saccharin, and any number of spray dried flavors. Flavoring agents include natural flavors extracted from plants such as fruits and synthetic blends of compounds which produce a pleasant sensation, such as, but not limited to peppermint and methyl salicylate. Wetting agents include propylene glycol monostearate, sorbitan monooleate, diethylene glycol monolaurate and polyoxyethylene laural ether. Emetic-coatings include fatty acids, fats, waxes, shellac, ammoniated shellac and cellulose acetate phthalates. Film coatings include hydroxyethylcellulose, sodium carboxymethylcellulose, polyethylene glycol 4000 and cellulose acetate phthalate.

The antibodies provided herein can be provided in a composition that protects it from the acidic environment of the stomach. For example, the composition can be formulated in an enteric coating that maintains its integrity in the stomach and releases the active compound in the intestine. The composition can also be formulated in combination with an antacid or other such ingredient.

When the dosage unit form is a capsule, it can contain, in addition to material of the above type, a liquid carrier such as a fatty oil. In addition, dosage unit forms can contain various other materials which modify the physical form of the dosage unit, for example, coatings of sugar and other enteric agents. The compounds can also be administered as a component of an elixir, suspension, syrup, wafer, sprinkle, chewing gum or the like. A syrup may contain, in addition to the active compounds, sucrose as a sweetening agent and certain preservatives, dyes and colorings and flavors.

The antibody can also be mixed with other active materials which do not impair the desired action, or with materials that supplement the desired action, such as antacids, H2 blockers, and diuretics. The active ingredient is an antibody or pharmaceutically acceptable derivative thereof as described herein. Higher concentrations, up to about 98% by weight of the active ingredient may be included.

In all embodiments, tablets and capsules formulations can be coated as known by those of skill in the art in order to modify or sustain dissolution of the active ingredient. Thus, for example, they may be coated with a conventional enterically digestible coating, such as phenylsalicylate, waxes and cellulose acetate phthalate.

In specific embodiments, the formulations are liquid dosage forms. Liquid oral dosage forms include aqueous solutions, emulsions, suspensions, solutions and/or suspensions reconstituted from non-effervescent granules and effervescent preparations reconstituted from effervescent granules. Aqueous solutions include, for example, elixirs and syrups. Emulsions are either oil-in-water or water-in-oil.

Elixirs are clear, sweetened, hydroalcoholic preparations. Pharmaceutically acceptable carriers used in elixirs include solvents. Syrups are concentrated aqueous solutions of a sugar, for example, sucrose, and may contain a preservative. An emulsion is a two-phase system in which one liquid is dispersed in the form of small globules throughout another liquid. Pharmaceutically acceptable carriers used in emulsions are non-aqueous liquids, emulsifying agents and preservatives. Suspensions use pharmaceutically acceptable suspending agents and preservatives. Pharmaceutically acceptable substances used in non-effervescent granules, to be reconstituted into a liquid oral dosage form, include diluents, sweeteners and wetting agents. Pharmaceutically acceptable substances used in effervescent granules, to be reconstituted into a liquid oral dosage form, include organic acids and a source of carbon dioxide. Coloring and flavoring agents are used in all of the above dosage forms.

Solvents include glycerin, sorbitol, ethyl alcohol and syrup. Examples of preservatives include glycerin, methyl and propylparaben, benzoic acid, sodium benzoate and alcohol. Examples of non-aqueous liquids utilized in emulsions include mineral oil and cottonseed oil. Examples of emulsifying agents include gelatin, acacia, tragacanth, bentonite, and surfactants such as polyoxyethylene sorbitan monooleate. Suspending agents include sodium carboxymethylcellulose, pectin, tragacanth, Veegum and acacia. Sweetening agents include sucrose, syrups, glycerin and artificial sweetening agents such as saccharin. Wetting agents include propylene glycol monostearate, sorbitan monooleate, diethylene glycol monolaurate and polyoxyethylene lauryl ether. Organic acids include citric and tartaric acid. Sources of carbon dioxide include sodium bicarbonate and sodium carbonate. Coloring agents include any of the approved certified water soluble FD and C dyes, and mixtures thereof. Flavoring agents include natural flavors extracted from plants such fruits, and synthetic blends of compounds which produce a pleasant taste sensation.

For a solid dosage form, the solution or suspension, in for example propylene carbonate, vegetable oils or triglycerides, is, in one embodiment, encapsulated in a gelatin capsule. Such solutions, and the preparation and encapsulation thereof, are disclosed in U.S. Pat. Nos. 4,328,245; 4,409,239; and 4,410,545. For a liquid dosage form, the solution, e.g., for example, in a polyethylene glycol, can be diluted with a sufficient quantity of a pharmaceutically acceptable liquid carrier, e.g., water, to be easily measured for administration.

Alternatively, liquid or semi-solid oral formulations can be prepared by dissolving or dispersing the active compound or salt in vegetable oils, glycols, triglycerides, propylene glycol esters (e.g., propylene carbonate) and other such carriers, and encapsulating these solutions or suspensions in hard or soft gelatin capsule shells. Other useful formulations include those set forth in U.S. Pat. Nos. RE28,819 and 4,358,603. Briefly, such formulations include, but are not limited to, those containing a compound provided herein, a dialkylated mono- or poly-alkylene glycol, including, but not limited to, 1,2-dimethoxymethane, diglyme, triglyme, tetraglyme, polyethylene glycol-350-dimethyl ether, polyethylene glycol-550-dimethyl ether, polyethylene glycol-750-dimethyl ether wherein 350, 550 and 750 refer to the approximate average molecular weight of the polyethylene glycol, and one or more antioxidants, such as butylated hydroxytoluene (BHT), butylated hydroxyanisole (BHA), propyl gallate, vitamin E, hydroquinone, hydroxycoumarins, ethanolamine, lecithin, cephalin, ascorbic acid, malic acid, sorbitol, phosphoric acid, thiodipropionic acid and its esters, and dithiocarbamates.

Other formulations include, but are not limited to, aqueous alcoholic solutions including a pharmaceutically acceptable acetal. Alcohols used in these formulations are any pharmaceutically acceptable water-miscible solvents having one or more hydroxyl groups, including, but not limited to, propylene glycol and ethanol. Acetals include, but are not limited to, di(lower alkyl) acetals of lower alkyl aldehydes such as acetaldehyde diethyl acetal.

Parenteral administration, in one embodiment, is characterized by injection, either subcutaneously, intramuscularly or intravenously is also contemplated herein. Injectables can be prepared in conventional forms, either as liquid solutions or suspensions, solid forms suitable for solution or suspension in liquid prior to injection, or as emulsions. The injectables, solutions and emulsions also contain one or more excipients. Suitable excipients are, for example, water, saline, dextrose, glycerol or ethanol. In addition, if desired, the pharmaceutical compositions to be administered can also contain minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Implantation of a slow-release or sustained-release system, such that a constant level of dosage is maintained (see, e.g., U.S. Pat. No. 3,710,795) is also contemplated herein. Briefly, a compound provided herein is dispersed in a solid inner matrix, e.g., polymethylmethacrylate, polybutylmethacrylate, plasticized or unplasticized polyvinylchloride, plasticized nylon, plasticized polyethyleneterephthalate, natural rubber, polyisoprene, polyisobutylene, polybutadiene, polyethylene, ethylene-vinylacetate copolymers, silicone rubbers, polydimethylsiloxanes, silicone carbonate copolymers, hydrophilic polymers such as hydrogels of esters of acrylic and methacrylic acid, collagen, cross-linked polyvinylalcohol and cross-linked partially hydrolyzed polyvinyl acetate, that is surrounded by an outer polymeric membrane, e.g., polyethylene, polypropylene, ethylene/propylene copolymers, ethylene/ethyl acrylate copolymers, ethylene/vinylacetate copolymers, silicone rubbers, polydimethyl siloxanes, neoprene rubber, chlorinated polyethylene, polyvinylchloride, vinylchloride copolymers with vinyl acetate, vinylidene chloride, ethylene and propylene, ionomer polyethylene terephthalate, butyl rubber epichlorohydrin rubbers, ethylene/vinyl alcohol copolymer, ethylene/vinyl acetate/vinyl alcohol terpolymer, and ethylene/vinyloxyethanol copolymer, that is insoluble in body fluids. The antibody diffuses through the outer polymeric membrane in a release rate controlling step. The amount of antibody contained in such parenteral compositions is highly dependent on the specific nature thereof, as well as the activity of the compound and the needs of the subject.

Preparations for parenteral administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use and sterile emulsions. The solutions may be either aqueous or nonaqueous.

If administered intravenously, suitable carriers include physiological saline or phosphate buffered saline (PBS), and solutions containing thickening and solubilizing agents, such as glucose, polyethylene glycol, and polypropylene glycol and mixtures thereof.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances.

Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcelluose, hydroxypropyl methylcellulose and polyvinylpyrrolidone. Emulsifying agents include Polysorbate 80 (TWEEN® 80). A sequestering or chelating agent of metal ions includes EDTA. Pharmaceutical carriers also include ethyl alcohol, polyethylene glycol and propylene glycol for water miscible vehicles; and sodium hydroxide, hydrochloric acid, citric acid or lactic acid for pH adjustment.

The concentration of the pharmaceutically active compound is adjusted so that an injection provides an effective amount to produce the desired pharmacological effect. The exact dose depends on the age, weight and condition of the patient or animal as is known in the art.

The unit-dose parenteral preparations can be packaged in an ampoule, a vial or a syringe with a needle. All preparations for parenteral administration can be sterile, as is known and practiced in the art.

Illustratively, intravenous or intraarterial infusion of a sterile aqueous solution containing an active compound is an effective mode of administration. Another embodiment is a sterile aqueous or oily solution or suspension containing an active material injected as necessary to produce the desired pharmacological effect.

Injectables are designed for local and systemic administration. In one embodiment, a therapeutically effective dosage is formulated to contain a concentration of at least about 0.1% w/w up to about 90% w/w or more, in certain embodiments more than 1% w/w of the active compound to the treated tissue(s).

The antibody can be suspended in micronized or other suitable form. The form of the resulting mixture depends upon a number of factors, including the intended mode of administration and the solubility of the compound in the selected carrier or vehicle. The effective concentration is sufficient for ameliorating the symptoms of the condition and may be empirically determined.

In other embodiments, the pharmaceutical formulations are lyophilized powders, which can be reconstituted for administration as solutions, emulsions and other mixtures. They may also be reconstituted and formulated as solids or gels.

The lyophilized powder is prepared by dissolving an antibody provided herein, or a pharmaceutically acceptable derivative thereof, in a suitable solvent. In some embodiments, the lyophilized powder is sterile. The solvent may contain an excipient which improves the stability or other pharmacological component of the powder or reconstituted solution, prepared from the powder. Excipients that may be used include, but are not limited to, dextrose, sorbital, fructose, corn syrup, xylitol, glycerin, glucose, sucrose or other suitable agent. The solvent may also contain a buffer, such as citrate, sodium or potassium phosphate or other such buffer known to those of skill in the art at, in one embodiment, about neutral pH. Subsequent sterile filtration of the solution followed by lyophilization under standard conditions known to those of skill in the art provides the desired formulation. In one embodiment, the resulting solution will be apportioned into vials for lyophilization. Each vial will contain a single dosage or multiple dosages of the compound. The lyophilized powder can be stored under appropriate conditions, such as at about 4° C. to room temperature.

Reconstitution of this lyophilized powder with water for injection provides a formulation for use in parenteral administration. For reconstitution, the lyophilized powder is added to sterile water or other suitable carrier. The precise amount depends upon the selected compound. Such amount can be empirically determined.

Topical mixtures are prepared as described for the local and systemic administration. The resulting mixture can be a solution, suspension, emulsions or the like and can be formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The antibodies provided herein can be formulated as aerosols for topical application, such as by inhalation (see, e.g., U.S. Pat. Nos. 4,044,126, 4,414,209, and 4,364,923, which describe aerosols for delivery of a steroid useful for treatment of inflammatory diseases, particularly asthma). These formulations for administration to the respiratory tract can be in the form of an aerosol or solution for a nebulizer, or as a microfine powder for insufflations, alone or in combination with an inert carrier such as lactose. In such a case, the particles of the formulation will, in one embodiment, have diameters of less than 50 microns, in one embodiment less than 10 microns.

The compounds can be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients can also be administered.

These solutions, particularly those intended for ophthalmic use, may be formulated as 0.01%-10% isotonic solutions, pH about 5-7, with appropriate salts.

Other routes of administration, such as transdermal patches, including iontophoretic and electrophoretic devices, and rectal administration, are also contemplated herein.

Transdermal patches, including iotophoretic and electrophoretic devices, are well known to those of skill in the art. For example, such patches are disclosed in U.S. Pat. Nos. 6,267,983, 6,261,595, 6,256,533, 6,167,301, 6,024,975, 6,010715, 5,985,317, 5,983,134, 5,948,433, and 5,860,957.

For example, pharmaceutical dosage forms for rectal administration are rectal suppositories, capsules and tablets for systemic effect. Rectal suppositories are used herein mean solid bodies for insertion into the rectum which melt or soften at body temperature releasing one or more pharmacologically or therapeutically active ingredients. Pharmaceutically acceptable substances utilized in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases may be used. Agents to raise the melting point of suppositories include spermaceti and wax. Rectal suppositories may be prepared either by the compressed method or by molding. The weight of a rectal suppository, in one embodiment, is about 2 to 3 gm.

Tablets and capsules for rectal administration can be manufactured using the same pharmaceutically acceptable substance and by the same methods as for formulations for oral administration.

The antibodies and other compositions provided herein may also be formulated to be targeted to a particular tissue, receptor, or other area of the body of the subject to be treated. Many such targeting methods are well known to those of skill in the art. All such targeting methods are contemplated herein for use in the instant compositions. For non-limiting examples of targeting methods, see, e.g., U.S.

Pat. Nos. 6,316,652, 6,274,552, 6,271,359, 6,253,872, 6,139,865, 6,131,570, 6,120,751, 6,071,495, 6,060,082, 6,048,736, 6,039,975, 6,004,534, 5,985,307, 5,972,366, 5,900,252, 5,840,674, 5,759,542 and 5,709,874.

In one embodiment, liposomal suspensions, including tissue-targeted liposomes, such as tumor-targeted liposomes, may also be suitable as pharmaceutically acceptable carriers. These can be prepared according to methods known to those skilled in the art. For example, liposome formulations can be prepared as described in U.S. Pat. No. 4,522,811. Briefly, liposomes such as multilamellar vesicles (MLV's) may be formed by drying down egg phosphatidyl choline and brain phosphatidyl serine (7:3 molar ratio) on the inside of a flask. A solution of a compound provided herein in phosphate buffered saline lacking divalent cations (PBS) is added and the flask shaken until the lipid film is dispersed. The resulting vesicles are washed to remove unencapsulated compound, pelleted by centrifugation, and then resuspended in PBS.

Methods of Administration and Dosing

Also provided herein are compositions comprising one or more antibodies provided herein for use in the prevention, treatment and/or alleviation of one or more symptom of a disease, such as a C10orf54-mediated disease.

In certain embodiments, provided herein are compositions comprising one or more antibodies provided herein for use in the management, prevention, or treatment of a C10orf54-mediated disease and/or the alleviation of one or more symptom of a C10orf54-mediated disease. Exemplary C10orf54-mediated diseases include a cell proliferative disorder, cancer, tumor, and graft-versus-host disease (GVHD), or a symptom thereof.

In certain embodiments, provided herein are compositions comprising one or more antibodies provided herein for use in the prevention, treatment and/or alleviation of one or more symptom of an C10orf54-mediated disease, such as a cell proliferative disorder. A cell proliferative disorder can include cancer or tumor formation, or a symptom thereof. In certain embodiments, the cell proliferative disorder is associated with increased expression and/or activity of C10orf54. For example, in certain embodiments, the cell proliferative disorder is associated with increased expression of C10orf54 on the surface of a cancer cell. Examples of cell proliferative disorders to be treated, prevented, or symptoms of which can be alleviated by the antibodies provided herein include, but are not limited to, bladder, breast, colon, connective tissue, rectal, gastric, esophageal, lung, laryx, kidney, oral, ovarian, or prostate cancers, or sarcomas, melanomas, gliomas, lymphomas or leukemias, or metatases of any of these cancers. Exemplary cell proliferative disorders include, but are not limited to, a leukemia, either acute or chronic, a fibrosarcoma, and a bladder cancer.

Leukemias are cancers of the blood-forming tissues characterized by distorted proliferation and development of leukocytes and their precursors in the blood and bone marrow. Leukemias are typically classified as either chronic (slowly progressing) or acute (rapidly progressing). Leukemias can be further classified based upon the type of blood cell affected. For example, leukemia of lymphoid cells include lymphoid leukemia, lymphocytic leukemia or lymphoblastic leukemia, and leukemia of myeloid cells include myeloid leukemia, myelogenous leukemia, myeloblastic leukemia or granulocytic leukemia. The four of the main types of leukemias that can be treated, prevented or symptoms thereof alleviated by the methods provided herein include acute lymphoblastic leukemia (ALL), chronic lymphocytic leukemia (CLL), acute myelogenous leukemia (AML) and chronic myelobastic leukemia (CML).

In one aspect, provided herein are methods for preventing or treating a disease described herein by administering to a subject a therapeutically effective amount, respectively, of an anti-C10orf54 antibody described herein, or a composition thereof. In certain embodiments, a method for treating the disease comprises administering to subject a therapeutically effective amount of a pharmaceutical formulation comprising an anti-C10orf54 antibody and a pharmaceutically acceptable carrier or excipient. A method provided herein can also optionally include at least one additional therapeutic agent, such as those provided herein, either as a separate treatment or conjugated or recombinately fused to an anti-C10orf54 antibody provided herein.

In one embodiment, an anti-C10orf54 antibody provided herein can be used for targeting C10orf54 expressed by the cancer cells by contacting the antibody with C10orf54 to form an antibody-antigen complex such that a conjugated or recombinately fused agent described herein accesses the interior of the cell. In one embodiment, the bound antibody is internalized into the cancer cell expressing C10orf54.

In certain embodiments, provided herein are compositions comprising one or more antibodies provided herein for use in the prevention, treatment and/or alleviation of one or more symptom of an C10orf54-mediated disease, such as GVHD, or a symptom thereof. GVHD generally occurs following allogeneic or matched unrelated bone marrow transplants (BMT).

In some embodiments, the GVHD is acute GVHD. The symptoms of acute GVHD can happen quickly and can be mild or severe. In certain instances, acute GVHD develops within about three months after transplant, such as when blood counts recover after transplant. It certain instances, the acute GVHD affects the skin, gastrointestinal (GI) tract and/or liver. For example, in some patients, acute skin GVHD begins with a rash, for example, on the palms of the patient's hands, soles of the feet, or shoulders. However, the rash can become widespread, and may be itchy and painful and/or might blister and peel. Acute liver GVHD may affect normal functions of the liver, such as liver enzymes, and may in turn, cause jaundice. Acute liver GVHD may also cause the patient's abdomen to become swollen and painful if the liver becomes enlarged. Finally, symptoms of acute gut GVHD (or GVHD of the digestive system) can include diarrhea, mucus or blood in the stool, cramping or abdominal pain, indigestion, nausea and/or loss of appetite. Other general symptoms of acute GVHD can include anemia, low grade fever, and/or being more prone to infections. Any combination of these symptoms of acute GVHD may be prevented, treated, and/or alleviated using the compositions and methods provided herein.

In other embodiments, the GVHD is chronic GVHD. Chronic GVHD can occur from about three months to about a year or longer after transplant. Chronic GVHD can be mild or severe, and generally includes symptoms similar to those of acute GVHD. Chronic GVHD can affect the skin and digestive system, including the liver but can also involve other organs and the immune system (e.g., making the patient more prone to infections) and/or connective tissues. Symptoms of chronic skin GVHD include a rash, dry skin, tight skin, itchy skin, darkening of the color of the skin, thickening of the skin, and/or may affect hair (e.g., hair loss, turning gray) or nails (e.g., hard or brittle nails). Chronic gut GVHD can affect the digestive system, mouth, esophagus, lining of the stomach, and/or lining of the bowel, and symptoms can include diarrhea, dry or sore mouth, painful swallowing, low nutrient absorption by the stomach, bloating, stomach cramps. Chronic liver GVHD can cause damage and scarring of the liver (cirrhosis). Chronic GVHD of the eyes can affect the glands that make tears, causing eyes to become dry, burning and painful or difficult to tolerate bright light. Chronic lung GVHD can cause shortness of breath, wheezing, persistent cough, and/or being more prone to chest infections. Chronic GVHD affects tendons (e.g., inflammation) that connect muscle to bone causing difficulty straightening or bending your arms and legs. Any combination of these symptoms of chronic GVHD may be prevented, treated, and/or alleviated using the compositions and methods provided herein.

In certain embodiments, an antibody provided herein may be used in, for example, in vitro, ex vivo, and in vivo therapeutic methods. In some embodiments, provided herein are methods for inhibiting cell growth or proliferation, either in vivo or in vitro, the method comprising contacting a cell with an effective amount of a composition or an anti-C10orf54 antibody provided herein. In some embodiments, an antibody provided herein may be used in a method for inducing cell death. The method can comprise contacting a cell with an effective amount of a composition or an anti-C10orf54 antibody provided herein. The methods can be performed under conditions permissive for binding of the antibody to a C10orf54 polypeptide, polypeptide fragment or epitope, such as, but not limited to when the C10orf54 polypeptide is expressed on the surface of a cell. For inhibiting the cell growth or proliferation of a cell, the inhibition can include decreasing a cell's growth or proliferation by at least 10%, 20%, 30%, 40%, 50%, 60%, 70%, 80%, 90%, 95%, or 100%, and can include cell death. In certain embodiments, the cell is a cancer cell or a pre-cancerous cell. In certain embodiments, the cell is a bladder, breast, colon, connective tissue, rectal, gastric, esophageal, lung, laryx, kidney, oral, ovarian, or prostate cancer cell, or a sarcoma, melanoma, glioma, lymphoma or leukemia cell. In certain embodiments, the cell is an immune cell expressing a C10orf54 polypeptide, such as, but not limited to, a regulatory T cell (i.e. a suppressor T cell).

An anti-C10orf54 antibody can be administered to a human for therapeutic or prophylactic purposes. Moreover, an anti-C10orf54 antibody can be administered to a non-human mammal expressing C10orf54 with which the antibody cross-reacts (e.g., a primate, pig, rat, or mouse) for veterinary purposes or as an animal model of human disease. Regarding the latter, such animal models may be useful for evaluating the therapeutic or prophylactic efficacy of antibodies or immunoconjugates provided herein (e.g., testing of dosages and time courses of administration).

In certain embodiments, an antibody provided herein can be used in a method of modulating an immune response in a subject. Such methods can include administering an effective amount of the composition of comprising an antibody provided herein to a subject. In some aspects, the modulating can include (a) increasing T cell activation; (b) increasing T cell proliferation; and/or (c) increasing cytokine production. Methods for assaying the modulation of an immune response are well known to one of skill in the art, and it is understood that a skill artisan would be able to readily conduct such assays.

In a specific embodiment, a composition for use in the management, prevention, treatment and/or alleviation of one or more symptom of a C10orf54-mediated disease comprises an antibody as described herein. In another specific embodiment, a composition for use in the management, prevention, treatment and/or alleviation of one or more symptom of a C10orf54-mediated disease comprises an antigen-binding fragment, a fusion protein or an functional fragment of an antibody as described herein.

In another embodiment, a composition for use in the management, prevention, treatment and/or alleviation of one or more symptom of a C10orf54-mediated disease comprises one or more antibodies described herein.

As discussed in more detail elsewhere herein, a composition provided herein may be used either alone or in combination with other compounds or compositions. Moreover, the antibodies may further be recombinantly fused to a heterologous polypeptide at the N- or C-terminus or chemically conjugated (including covalently and non-covalently conjugations) to polypeptides or other compositions. For example, antibodies provided herein may be recombinantly fused or conjugated to molecules useful as labels in detection assays and effector molecules such as heterologous polypeptides, drugs, radionucleotides, or toxins. See, e.g., PCT publications WO 92/08495; WO 91/14438; WO 89/12624; U.S. Pat. No. 5,314,995; and EP 396,387.

Antibodies provided herein may be used, for example, to purify, detect, and target C10orf54 antigens, in both in vitro and in vivo diagnostic and therapeutic methods. For example, the modified antibodies have use in immunoassays for qualitatively and quantitatively measuring levels of C10orf54 in biological samples. See, e.g., Harlow et al., Antibodies: A Laboratory Manual, (Cold Spring Harbor Laboratory Press, 2nd ed. 1988) (incorporated by reference herein in its entirety).

Also provided herein are methods of managing, treating, preventing and/or ameliorating one or more symptom of a C10orf54-mediated disease by administrating to a subject of an effective amount of an antibody, or pharmaceutical composition comprising an antibody provided herein. In one aspect, an antibody is substantially purified (e.g., substantially free from substances that limit its effect or produce undesired side-effects). In specific embodiments, the antibody is a humanized monoclonal antibody. The subject administered a therapy can be a mammal such as non-primate (e.g., cows, pigs, horses, cats, dogs, rats etc.) or a primate (e.g., a monkey, such as a cynomolgous monkey, or a human). In a specific embodiment, the subject is a human. In another embodiment, the subject is a human with a C10orf54-mediated disease.

Various delivery systems are known and can be used to administer a prophylactic or therapeutic agent (e.g., an antibody provided herein), including, but not limited to, encapsulation in liposomes, microparticles, microcapsules, recombinant cells capable of expressing the antibody, receptor-mediated endocytosis (see, e.g., Wu and Wu, J. Biol. Chem. 262:4429-4432 (1987)), construction of a nucleic acid as part of a retroviral or other vector, etc. Methods of administering a prophylactic or therapeutic agent (e.g., an antibody provided herein), or pharmaceutical composition include, but are not limited to, parenteral administration (e.g., intradermal, intramuscular, intraperitoneal, intravenous and subcutaneous), epidural, and mucosal (e.g., intranasal and oral routes). In a specific embodiment, a prophylactic or therapeutic agent (e.g., an antibody provided herein), or a pharmaceutical composition is administered intranasally, intramuscularly, intravenously, or subcutaneously. The prophylactic or therapeutic agents, or compositions may be administered by any convenient route, for example by infusion or bolus injection, by absorption through epithelial or mucocutaneous linings (e.g., oral mucosa, intranasal mucosa, rectal and intestinal mucosa, etc.) and may be administered together with other biologically active agents. Administration can be systemic or local. In addition, pulmonary administration can also be employed, e.g., by use of an inhaler or nebulizer, and formulation with an aerosolizing agent. See, e.g., U.S. Pat. Nos. 6,019,968, 5,985,320, 5,985,309, 5,934,272, 5,874,064, 5,855,913, 5,290,540, and 4,880,078; and PCT Publication Nos. WO 92/19244, WO 97/32572, WO 97/44013, WO 98/31346, and WO 99/66903, each of which is incorporated herein by reference their entirety.

In a specific embodiment, it may be desirable to administer a prophylactic or therapeutic agent, or a pharmaceutical composition provided herein locally to the area in need of treatment. This may be achieved by, for example, and not by way of limitation, local infusion, by topical administration (e.g., by intranasal spray), by injection, or by means of an implant, the implant being of a porous, non-porous, or gelatinous material, including membranes, such as sialastic membranes, or fibers. In certain embodiments, when administering an antibody provided herein, care must be taken to use materials to which the antibody does not absorb.

In another embodiment, a therapeutic agent or composition provided herein can be delivered in a vesicle, in particular a liposome (see Langer, 1990, Science 249:1527-1533; Treat et al., in Liposomes in the Therapy of Infectious Disease and Cancer, Lopez-Berestein and Fidler (eds.), Liss, N.Y., pp. 353-365 (1989); Lopez-Berestein, ibid., pp. 317-327; see generally ibid.).

In another embodiment, a therapeutic agent or composition provided herein can be delivered in a controlled release or sustained release system. In one embodiment, a pump may be used to achieve controlled or sustained release (see Langer, supra; Sefton, 1987, CRC Crit. Ref. Biomed. Eng. 14:20; Buchwald et al., 1980, Surgery 88:507; Saudek et al., 1989, N. Engl. J. Med. 321:574). In another embodiment, polymeric materials can be used to achieve controlled or sustained release of a therapeutic agent (e.g., an antibody provided herein) or a composition provided herein (see e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, N.Y. (1984); Ranger and Peppas, 1983, J., Macromol. Sci. Rev. Macromol. Chem. 23:61; see also Levy et al., 1985, Science 228:190; During et al., 1989, Ann. Neurol. 25:351; Howard et al., 1989, J. Neurosurg. 7 1:105); U.S. Pat. Nos. 5,679,377; 5,916,597; 5,912,015; 5,989,463; 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly (acrylic acid), poly(ethylene-co-vinyl acetate), poly(methacrylic acid), polyglycolides (PLG), polyanhydrides, poly (N-vinyl pyrrolidone), poly(vinyl alcohol), polyacrylamide, poly(ethylene glycol), polylactides (PLA), poly(lactide-co-glycolides) (PLGA), and polyorthoesters. In a specific embodiment, the polymer used in a sustained release formulation is inert, free of leachable impurities, stable on storage, sterile, and biodegradable. In yet another embodiment, a controlled or sustained release system can be placed in proximity of the therapeutic target, e.g., the nasal passages or lungs, thus requiring only a fraction of the systemic dose (see, e.g., Goodson, in Medical Applications of Controlled Release, supra, vol. 2, pp. 115-138 (1984)). Controlled release systems are discussed in the review by Langer (1990, Science 249:1527-1533). Any technique known to one of skill in the art can be used to produce sustained release formulations comprising one or more antibodies provided herein. See, e.g., U.S. Pat. No. 4,526,938, PCT publication WO 91/05548, PCT publication WO 96/20698, Ning et al., 1996, "Intratumoral Radioimmunotherapy of a Human Colon Cancer Xenograft Using a Sustained-Release Gel," Radiotherapy & Oncology 39:179-189, Song et al., 1995, "Antibody Mediated Lung Targeting of Long-Circulating Emulsions," PDA Journal of Pharmaceutical Science & Technology 50:372-397, Cleek et al., 1997, "Biodegradable Polymeric Carriers for a bFGF Antibody for Cardiovascular Application," Pro. Intl. Symp. Control. Rel. Bioact. Mater. 24:853-854, and Lam et al., 1997, "Microencapsulation of Recombinant Humanized Monoclonal Antibody for Local Delivery," Proc. Intl. Symp. Control Rel. Bioact. Mater. 24:759-760.

In a specific embodiment, where the composition provided herein is a nucleic acid encoding a prophylactic or therapeutic agent (e.g., an antibody provided herein), the nucleic acid can be administered in vivo to promote expression of its encoded therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell surface receptors or transfecting agents, or by administering it in linkage to a homeobox-like peptide which is known to enter the nucleus (see, e.g., Joliot et al., 1991, Proc. Natl. Acad. Sci. USA 88:1864-1868), etc. Alternatively, a nucleic acid can be introduced intracellularly and incorporated within host cell DNA for expression by homologous recombination.

In a specific embodiment, a composition comprises one, two or more antibodies provided herein. In another embodiment, a composition comprises one, two or more antibodies provided herein and a prophylactic or therapeutic agent other than an antibody provided herein. In certain embodiments, the agents are known to be useful for or have been or are currently used for the prevention, treatment and/or alleviation of one or more symptom of a C10orf54-mediated disease. In addition to prophylactic or therapeutic agents, the compositions provided herein may also comprise a carrier.

The compositions provided herein include bulk drug compositions useful in the manufacture of pharmaceutical compositions (e.g., compositions that are suitable for administration to a subject or patient) that can be used in the preparation of unit dosage forms. In a specific embodiment, a composition provided herein is a pharmaceutical composition. Such compositions comprise a prophylactically or therapeutically effective amount of one or more prophylactic or therapeutic agents (e.g., an antibody provided herein or other prophylactic or therapeutic agent), and a pharmaceutically acceptable carrier. In certain embodiments, the pharmaceutical compositions are formulated to be suitable for the route of administration to a subject.

In a specific embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocamne to ease pain at the site of the injection. Such compositions, however, may be administered by a route other than intravenous.

Generally, the ingredients of compositions provided herein are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

In certain embodiments, an antibody provided herein is packaged in a hermetically sealed container such as an ampoule or sachette indicating the quantity of antibody. In one embodiment, the antibody is supplied as a dry sterilized lyophilized powder or water free concentrate in a hermetically sealed container and can be reconstituted, e.g., with water or saline to the appropriate concentration for administration to a subject. In certain embodiments, the antibody is supplied as a dry sterile lyophilized powder in a hermetically sealed container at a unit dosage of at least 0.1 mg, at least 0.5 mg, at least 1 mg, at least 2 mg, or at least 3 mg, such as at least 5 mg, at least 10 mg, at least 15 mg, at least 25 mg, at least 30 mg, at least 35 mg, at least 45 mg, at least 50 mg, at least 60 mg, at least 75 mg, at least 80 mg, at least 85 mg, at least 90 mg, at least 95 mg, or at least 100 mg. The lyophilized antibody can be stored at between 2 and 8° C. in its original container and the antibody can be administered within 12 hours, such as within 6 hours, within 5 hours, within 3 hours, or within 1 hour after being reconstituted. In an alternative embodiment, an antibody is supplied in liquid form in a hermetically sealed container indicating the quantity and concentration of the antibody. In certain embodiments, the liquid form of the antibody is supplied in a hermetically sealed container at least 0.1 mg/ml, at least 0.5 mg/ml, or at least 1 mg/ml, such as at least 5 mg/ml, at least 10 mg/ml, at least 15 mg/ml, at least 25 mg/ml, at least 30 mg/ml, at least 40 mg/ml, at least 50 mg/ml, at least 60 mg/ml, at least 70 mg/ml, at least 80 mg/ml, at least 90 mg/ml, or at least 100 mg/ml.

The compositions provided herein can be formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The amount of a therapeutic agent (e.g., an antibody provided herein) or a composition provided herein that will be effective in the prevention, treatment and/or alleviation of one or more symptom of a C10orf54-mediated disease can be determined by standard clinical techniques.

Accordingly, a dosage of an antibody or a composition that results in a serum titer of from about 0.1 µg/ml to about 450 µg/ml, and in some embodiments at least 0.1 µg/ml, at least 0.2 µg/ml, at least 0.4 µg/ml, at least 0.5 µg/ml, at least 0.6 µg/ml, at least 0.8 µg/ml, at least 1 µg/ml, at least 1.5 µg/ml, such as at least 2 µg/ml, at least 5 µg/ml, at least 10 µg/ml, at least 15 µg/ml, at least 20 µg/ml, at least 25 µg/ml, at least 30 µg/ml, at least 35 µg/ml, at least 40 µg/ml, at least 50 µg/ml, at least 75 µg/ml, at least 100 µg/ml, at least 125 µg/ml, at least 150 µg/ml, at least 200 µg/ml, at least 250 µg/ml, at least 300 µg/ml, at least 350 µg/ml, at least 400 µg/ml, or at least 450 µg/ml can be administered to a human for the prevention, treatment and/or alleviation of one or more symptom of a C10orf54-mediated disease. In addition, in vitro assays may optionally be employed to help identify optimal dosage ranges. The precise dose to be employed in the formulation will also depend on the route of administration, and the seriousness of a C10orf54-mediated disease, and should be decided according to the judgment of the practitioner and each patient's circumstances.

Effective doses may be extrapolated from dose-response curves derived from in vitro or animal model test systems.

For the antibodies provided herein, the dosage administered to a patient can be, in certain embodiments, 0.1 mg/kg to 100 mg/kg of the patient's body weight. In some embodiments, the dosage administered to the patient is about 1 mg/kg to about 75 mg/kg of the patient's body weight. In certain embodiments, the dosage administered to a patient is between 1 mg/kg and 20 mg/kg of the patient's body weight, such as 1 mg/kg to 5 mg/kg of the patient's body weight. Generally, human antibodies have a longer half-life within the human body than antibodies from other species due to the immune response to the foreign polypeptides. Thus, lower dosages of human antibodies and less frequent administration is often possible. Further, the dosage and frequency of administration of the antibodies provided herein may be reduced by enhancing uptake and tissue penetration of the antibodies by modifications such as, for example, lipidation.

In one embodiment, approximately 100 mg/kg or less, approximately 75 mg/kg or less, approximately 50 mg/kg or less, approximately 25 mg/kg or less, approximately 10 mg/kg or less, approximately 5 mg/kg or less, approximately 1 mg/kg or less, approximately 0.5 mg/kg or less, or approximately 0.1 mg/kg or less of an antibody provided herein is administered 5 times, 4 times, 3 times, 2 times or 1 time to prevent, treat or alleviate one or more symptom of a C10orf54-mediated disease. In some embodiments, an antibody provided herein is administered about 1-12 times, wherein the doses may be administered as necessary, e.g., weekly, biweekly, monthly, bimonthly, trimonthly, etc., as determined by a physician. In some embodiments, a lower dose (e.g., 1-15 mg/kg) can be administered more frequently (e.g., 3-6 times). In other embodiments, a higher dose (e.g., 25-100 mg/kg) can be administered less frequently (e.g., 1-3 times). However, as will be apparent to those in the art, other dosing amounts and schedules are easily determinable and within the scope of the disclosure.

In a specific embodiment, approximately 100 mg/kg, approximately 75 mg/kg or less, approximately 50 mg/kg or less, approximately 25 mg/kg or less, approximately 10 mg/kg or less, approximately 5 mg/kg or less, approximately 1 mg/kg or less, approximately 0.5 mg/kg or less, approximately 0.1 mg/kg or less of an antibody provided herein in a sustained release formulation is administered to a subject, such as a human, to prevent, treat and/or alleviate one or more symptom of a C10orf54-mediated disease. In another specific embodiment, an approximately 100 mg/kg, approximately 75 mg/kg or less, approximately 50 mg/kg or less, approximately 25 mg/kg or less, approximately 10 mg/kg or less, approximately 5 mg/kg or less, approximately 1 mg/kg or less, approximately 0.5 mg/kg or less, or approximately 0.1 mg/kg or less bolus of an antibody provided herein not in a sustained release formulation is administered to a subject, such as a human, to prevent, treat and/or alleviate one or more symptom of a C10orf54-mediated disease, and after a certain period of time, approximately 100 mg/kg, approximately 75 mg/kg or less, approximately 50 mg/kg or less, approximately 25 mg/kg or less, approximately 10 mg/kg or less, approximately 5 mg/kg or less, approximately 1 mg/kg or less, approximately 0.5 mg/kg or less, or approximately 5 mg/kg or less of an antibody provided herein in a sustained release is administered to the subject (e.g., intranasally or intramuscularly) one, two, three or four times. In accordance with this embodiment, a certain period of time can be 1 to 5 days, a week, two weeks, or a month.

In some embodiments, a single dose of an antibody provided herein is administered to a patient to prevent, treat and/or alleviate one or more symptom of a C10orf54-mediated disease two, three, four, five, six, seven, eight, nine, ten, eleven, twelve times, thirteen, fourteen, fifteen, sixteen, seventeen, eighteen, nineteen, twenty, twenty-one, twenty-two, twenty-three, twenty-four, twenty five, or twenty six at bi-weekly (e.g., about 14 day) intervals over the course of a year, wherein the dose is selected from the group consisting of about 0.1 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, or a combination thereof (e.g., each dose monthly dose may or may not be identical).

In another embodiment, a single dose of an antibody provided herein is administered to patient to prevent, treat and/or alleviate one or more symptom of a C10orf54-mediated disease two, three, four, five, six, seven, eight, nine, ten, eleven, or twelve times at about monthly (e.g., about 30 day) intervals over the course of a year, wherein the dose is selected from the group consisting of about 0.1 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, or a combination thereof (e.g., each dose monthly dose may or may not be identical).

In one embodiment, a single dose of an antibody provided herein is administered to a patient to treat, prevent and/or alleviate a symptom of a C10orf54-mediated disease two, three, four, five, or six times at about bi-monthly (e.g., about 60 day) intervals over the course of a year, wherein the dose is selected from the group consisting of about 0.1 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, or a combination thereof (e.g., each bi-monthly dose may or may not be identical).

In some embodiments, a single dose of an antibody provided herein is administered to a patient to treat, prevent and/or alleviate one or more symptom of a C10orf54-mediated disease two, three, or four times at about tri-monthly (e.g., about 120 day) intervals over the course of a year, wherein the dose is selected from the group consisting of about 0.1 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, or a combination thereof (e.g., each tri-monthly dose may or may not be identical).

In certain embodiments, the route of administration for a dose of an antibody provided herein to a patient is intranasal, intramuscular, intravenous, or a combination thereof, but other routes described herein are also acceptable. Each dose may or may not be administered by an identical route of administration. In some embodiments, an antibody provided herein may be administered via multiple routes of administration simultaneously or subsequently to other doses of the same or a different antibody provided herein.

In certain embodiments, antibodies provided herein are administered prophylactically or therapeutically to a subject. Antibodies can be prophylactically or therapeutically administered to a subject so as to prevent, lessen or alleviate a C10orf54-mediated disease or symptom thereof.

Diagnostic Use of Antibodies

Labeled antibodies provided herein and derivatives and analogs thereof, which bind to a C10orf54 antigen can be used for diagnostic purposes to detect, diagnose, or monitor a C10orf54-mediated disease. Also provided herein are methods for the detection of a C10orf54-mediated disease comprising: (a) assaying the expression of a C10orf54 antigen in cells or a tissue sample of a subject using one or more antibodies provided herein that bind to the C10orf54 antigen; and (b) comparing the level of the C10orf54 antigen with a control level, e.g., levels in normal tissue samples (e.g., from a patient not having a C10orf54-mediated disease, or from the same patient before disease onset), whereby an increase in the assayed level of C10orf54 antigen compared to the control level of the C10orf54 antigen is indicative of a C10orf54-mediated disease.

Also provided herein is a diagnostic assay for diagnosing a C10orf54-mediated disease comprising: (a) assaying for the level of a C10orf54 antigen in cells or a tissue sample of an individual using one or more antibodies provided herein that bind to a C10orf54 antigen; and (b) comparing the level of the C10orf54 antigen with a control level, e.g., levels in normal tissue samples, whereby an increase in the assayed C10orf54 antigen level compared to the control level of the C10orf54 antigen is indicative of a C10orf54-mediated disease. A more definitive diagnosis of a C10orf54-mediated disease may allow health professionals to employ preventative measures or aggressive treatment earlier thereby preventing the development or further progression of the C10orf54-mediated disease.

Antibodies provided herein can be used to assay C10orf54 antigen levels in a biological sample using classical immunohistological methods as described herein or as known to those of skill in the art (e.g., see Jalkanen et al., 1985, J. Cell. Biol. 101:976-985; and Jalkanen et al., 1987, J. Cell. Biol. 105:3087-3096). Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase; radioisotopes, such as iodine ($^{125}$I, $^{121}$I), carbon ($^{14}$C), sulfur ($^{35}$S), tritium ($^{3}$H), indium ($^{121}$In), and technetium ($^{99}$Tc); luminescent labels, such as luminol; and fluorescent labels, such as fluorescein and rhodamine, and biotin.

One aspect provided herein is the detection and diagnosis of a C10orf54-mediated disease in a human. In one embodiment, diagnosis comprises: a) administering (for example, parenterally, subcutaneously, or intraperitoneally) to a subject an effective amount of a labeled antibody that binds to a C10orf54 antigen; b) waiting for a time interval following the administering for permitting the labeled antibody to preferentially concentrate at sites in the subject where the C10orf54 antigen is expressed (and for unbound labeled molecule to be cleared to background level); c) determining background level; and d) detecting the labeled antibody in the subject, such that detection of labeled antibody above the background level indicates that the subject has a C10orf54-mediated disease. Background level can be determined by various methods including, comparing the amount of labeled molecule detected to a standard value previously determined for a particular system.

It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99}$Tc. The labeled antibody will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982).

Depending on several variables, including the type of label used and the mode of administration, the time interval following the administration for permitting the labeled antibody to preferentially concentrate at sites in the subject and for unbound labeled antibody to be cleared to background level is 6 to 48 hours or 6 to 24 hours or 6 to 12 hours. In another embodiment the time interval following administration is 5 to 20 days or 5 to 10 days.

In one embodiment, monitoring of a C10orf54-mediated disease is carried out by repeating the method for diagnosing the a C10orf54-mediated disease, for example, one month after initial diagnosis, six months after initial diagnosis, one year after initial diagnosis, etc.

Presence of the labeled molecule can be detected in the subject using methods known in the art for in vivo scanning. These methods depend upon the type of label used. Skilled artisans will be able to determine the appropriate method for detecting a particular label. Methods and devices that may be used in the diagnostic methods provided herein include, but are not limited to, computed tomography (CT), whole body scan such as position emission tomography (PET), magnetic resonance imaging (MRI), and sonography.

In a specific embodiment, the molecule is labeled with a radioisotope and is detected in the patient using a radiation responsive surgical instrument (Thurston et al., U.S. Pat. No. 5,441,050). In another embodiment, the molecule is labeled with a fluorescent compound and is detected in the patient using a fluorescence responsive scanning instrument. In another embodiment, the molecule is labeled with a positron emitting metal and is detected in the patient using positron emission-tomography. In yet another embodiment, the molecule is labeled with a paramagnetic label and is detected in a patient using magnetic resonance imaging (MRI).

Methods of Producing Antibodies

Antibodies provided herein that bind to an antigen can be produced by any method known in the art for the synthesis of antibodies, in particular, by chemical synthesis or by recombinant expression techniques. The practice of the disclosure employs, unless otherwise indicated, conventional techniques in molecular biology, microbiology, genetic analysis, recombinant DNA, organic chemistry, biochemistry, PCR, oligonucleotide synthesis and modification, nucleic acid hybridization, and related fields within the skill of the art. These techniques are described in the references cited herein and are fully explained in the literature. See, e.g., Maniatis et al. (1982) *Molecular Cloning: A Laboratory Manual*, Cold Spring Harbor Laboratory Press; Sambrook et al. (1989), *Molecular Cloning: A Laboratory Manual*, Second Edition, Cold Spring Harbor Laboratory Press; Sambrook et al. (2001) *Molecular Cloning: A Laboratory Manual*, Cold Spring Harbor Laboratory Press, Cold Spring Harbor, N.Y.; Ausubel et al., *Current Protocols in Molecular Biology*, John Wiley & Sons (1987 and annual updates); *Current Protocols in Immunology*, John Wiley & Sons (1987 and annual updates) Gait (ed.) (1984) *Oligonucleotide Synthesis: A Practical Approach*, IRL Press; Eckstein (ed.) (1991) *Oligonucleotides and Analogues: A Practical Approach*, IRL Press; Birren et al. (eds.) (1999) *Genome Analysis: A Laboratory Manual*, Cold Spring Harbor Laboratory Press.

Polyclonal antibodies that bind to an antigen can be produced by various procedures well-known in the art. For example, a human antigen can be administered to various host animals including, but not limited to, rabbits, mice, rats, etc. to induce the production of sera containing polyclonal antibodies specific for the human antigen. Various adjuvants may be used to increase the immunological response, depending on the host species, and include but are not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and *Corynebacterium parvum*. Such adjuvants are also well known in the art.

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., *Antibodies: A Laboratory Manual*, (Cold Spring Harbor Laboratory Press, 2nd ed. 1988); Hammerling et al., in: *Monoclonal Antibodies and T-Cell Hybridomas* 563 681 (Elsevier, N.Y., 1981) (the references incorporated by reference in their entireties). The term "monoclonal antibody" as used herein is not limited to antibodies produced through hybridoma technology. Other exemplary methods of producing monoclonal antibodies are discussed elsewhere herein, such as e.g., use of the KM Mouse™. Additional exemplary methods of producing monoclonal antibodies are provided in the Examples herein.

Methods for producing and screening for specific antibodies using hybridoma technology are routine and well known in the art. Briefly, mice can be immunized with a C10orf54 antigen and once an immune response is detected, e.g., antibodies specific for C10orf54 antigen are detected in the mouse serum, the mouse spleen is harvested and splenocytes isolated. The splenocytes are then fused by well known techniques to any suitable myeloma cells, for example cells from cell line SP20 available from the ATCC. Hybridomas are selected and cloned by limited dilution.

Additionally, a RIMMS (repetitive immunization multiple sites) technique can be used to immunize an animal (Kilptrack et al., 1997 Hybridoma 16:381-9, incorporated by reference in its entirety). The hybridoma clones are then assayed by methods known in the art for cells that secrete antibodies capable of binding a given polypeptide. Ascites fluid, which generally contains high levels of antibodies, can be generated by immunizing mice with positive hybridoma clones.

Accordingly, also provided herein are methods of generating antibodies by culturing a hybridoma cell secreting a modified antibody provided herein wherein, in certain embodiments, the hybridoma is generated by fusing splenocytes isolated from a mouse immunized with a C10orf54 antigen with myeloma cells and then screening the hybridomas resulting from the fusion for hybridoma clones that secrete an antibody able to bind to a C10orf54 antigen.

Antibody fragments which recognize specific C10orf54 antigens may be generated by any technique known to those of skill in the art. For example, Fab and F(ab')$_2$ fragments provided herein may be produced by proteolytic cleavage of immunoglobulin molecules, using enzymes such as papain (to produce Fab fragments) or pepsin (to produce F(ab')$_2$ fragments). F(ab')$_2$ fragments contain the variable region, the light chain constant region and the CH1 domain of the heavy chain. Further, the antibodies provided herein can also be generated using various phage display methods known in the art.

For example, antibodies can also be generated using various phage display methods. In phage display methods, functional antibody domains are displayed on the surface of phage particles which carry the polynucleotide sequences encoding them. In particular, DNA sequences encoding VH and VL domains are amplified from animal cDNA libraries (e.g., human or murine cDNA libraries of affected tissues). The DNA encoding the VH and VL domains are recombined together with an scFv linker by PCR and cloned into a phagemid vector. The vector is electroporated in E. coli and the E. coli is infected with helper phage. Phage used in these methods are typically filamentous phage including fd and M13 and the VH and VL domains are usually recombinantly fused to either the phage gene III or gene VIII. Phage expressing an antigen binding domain that binds to a particular antigen can be selected or identified with antigen, e.g., using labeled antigen or antigen bound or captured to a solid surface or bead. Examples of phage display methods that can be used to make the antibodies provided herein include those disclosed in Brinkman et al., 1995, J. Immunol. Methods 182:41-50; Ames et al., 1995, J. Immunol. Methods 184:177-186; Kettleborough et al., 1994, Eur. J. Immunol. 24:952-958; Persic et al., 1997, Gene 187:9-18; Burton et al., 1994, Advances in Immunology 57:191-280; PCT Application No. PCT/GB91/O1 134; International Publication Nos. WO 90/02809, WO 91/10737, WO 92/01047, WO 92/18619, WO 93/1 1236, WO 95/15982, WO 95/20401, and WO97/13844; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727, 5,733,743 and 5,969,108; each of which is incorporated herein by reference in its entirety.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described below. Techniques to recombinantly produce Fab, Fab' and F(ab')$_2$ fragments can also be employed using methods known in the art such as those disclosed in PCT publication No. WO 92/22324; Mullinax et al., 1992, BioTechniques 12(6):864-869; Sawai et al., 1995, AJRI 34:26-34; and Better et al., 1988, Science 240:1041-1043 (the references incorporated by reference in their entireties).

To generate whole antibodies, PCR primers including VH or VL nucleotide sequences, a restriction site, and a flanking sequence to protect the restriction site can be used to amplify the VH or VL sequences in scFv clones. Utilizing cloning techniques known to those of skill in the art, the PCR amplified VH domains can be cloned into vectors expressing a VH constant region, e.g., the human gamma 4 constant region, and the PCR amplified VL domains can be cloned into vectors expressing a VL constant region, e.g., human kappa or lambda constant regions. The VH and VL domains may also cloned into one vector expressing the necessary constant regions. The heavy chain conversion vectors and light chain conversion vectors are then co-transfected into cell lines to generate stable or transient cell lines that express full-length antibodies, e.g., IgG, using techniques known to those of skill in the art.

For some uses, including in vivo use of antibodies in humans and in vitro detection assays, human or chimeric antibodies can be used. Completely human antibodies are particularly desirable for therapeutic treatment of human subjects. Human antibodies can be made by a variety of methods known in the art including phage display methods described above using antibody libraries derived from human immunoglobulin sequences. See also U.S. Pat. Nos. 4,444,887 and 4,716,111; and International Publication Nos. WO 98/46645, WO 98/50433, WO 98/24893, WO 98/16654, WO 96/34096, WO 96/33735, and WO 91/10741; each of which is incorporated herein by reference in its entirety.

In specific embodiments, human antibodies are produced. Human antibodies and/or fully human antibodies can be produced using any method known in the art, including the Examples provided herein. For example, transgenic mice which are incapable of expressing functional endogenous immunoglobulins, but which can express human immunoglobulin genes. For example, the human heavy and light chain immunoglobulin gene complexes may be introduced randomly or by homologous recombination into mouse embryonic stem cells. Alternatively, the human variable region, constant region, and diversity region may be introduced into mouse embryonic stem cells in addition to the human heavy and light chain genes. The mouse heavy and light chain immunoglobulin genes may be rendered non functional separately or simultaneously with the introduction of human immunoglobulin loci by homologous recombination. In particular, homozygous deletion of the $J_H$ region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of the polypeptide. Monoclonal antibodies directed against the antigen can be obtained from the immunized, transgenic mice using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA, IgM and IgE antibodies. For an overview of this technology for producing human antibodies, see Lonberg and Huszar (1995, Int. Rev. Immunol. 13:65-93). For a detailed discussion of this technology for producing human antibodies and human monoclonal antibodies and protocols for producing such antibodies, see, e.g., PCT publication Nos. WO 98/24893, WO 96/34096, and WO 96/33735; and U.S. Pat. Nos. 5,413,923, 5,625,126, 5,633, 425, 5,569,825, 5,661,016, 5,545,806, 5,814,318, and 5,939, 598, which are incorporated by reference herein in their entirety. Other methods are detailed in the Examples herein. In addition, companies such as Abgenix, Inc. (Freemont, Calif.) and Genpharm (San Jose, Calif.) can be engaged to provide human antibodies directed against a selected antigen using technology similar to that described above.

A chimeric antibody is a molecule in which different portions of the antibody are derived from different immunoglobulin molecules. Methods for producing chimeric antibodies are known in the art. See, e.g., Morrison, 1985, Science 229:1202; Oi et al., 1986, BioTechniques 4:214; Gillies et al., 1989, J. Immunol. Methods 125:191-202; and U.S. Pat. Nos. 5,807,715, 4,816,567, 4,816,397, and 6,331,415, which are incorporated herein by reference in their entirety.

A humanized antibody is an antibody or its variant or fragment thereof which is capable of binding to a predetermined antigen and which comprises a framework region having substantially the amino acid sequence of a human immunoglobulin and a CDR having substantially the amino acid sequence of a non-human immunoglobulin. A humanized antibody comprises substantially all of at least one, and typically two, variable domains (Fab, Fab', F(ab')$_2$, Fabc, Fv) in which all or substantially all of the CDR regions correspond to those of a non human immunoglobulin (e.g., donor antibody) and all or substantially all of the framework regions are those of a human immunoglobulin consensus sequence. In certain embodiments, a humanized antibody also comprises at least a portion of an immunoglobulin constant region (Fc), typically that of a human immunoglobulin. Ordinarily, the antibody will contain both the light chain as well as at least the variable domain of a heavy chain. The antibody also may include the CH1, hinge, CH2, CH3, and CH4 regions of the heavy chain. The humanized antibody can be selected from any class of immunoglobulins, including IgM, IgG, IgD, IgA and IgE, and any isotype, including IgG1, IgG2, IgG3 and IgG4. Usually the constant domain is a complement fixing constant domain where it is desired that the humanized antibody exhibit cytotoxic activity, and the class is typically IgG1. Where such cytotoxic activity is not desirable, the constant domain may be of the IgG2 class. Examples of VL and VH constant domains that can be used in certain embodiments include, but are not limited to, C-kappa and C-gamma-1 (nG1m) described in Johnson et al. (1997) *J. Infect. Dis.* 176, 1215-1224 and those described in U.S. Pat. No. 5,824,307. The humanized antibody may comprise sequences from more than one class or isotype, and selecting particular constant domains to optimize desired effector functions is within the ordinary skill in the art. The framework and CDR regions of a humanized antibody need not correspond precisely to the parental sequences, e.g., the donor CDR or the consensus framework may be mutagenized by substitution, insertion or deletion of at least one residue so that the CDR or framework residue at that site does not correspond to either the consensus or the import antibody. Such mutations, however, will not be extensive. Usually, at least 75% of the humanized antibody residues will correspond to those of the parental FR and CDR sequences, more often 90%, or greater than 95%. Humanized antibodies can be produced using variety of techniques known in the art, including but not limited to, CDR-grafting (European Patent No. EP 239,400; International publication No. WO 91/09967; and U.S. Pat. Nos. 5,225,539, 5,530,101, and 5,585,089), veneering or resurfacing (European Patent Nos. EP 592,106 and EP 519,596; Padlan, 1991, Molecular Immunology 28(4/5):489-498; Studnicka et al., 1994, Protein Engineering 7(6):805-814; and Roguska et al., 1994, PNAS 91:969-973), chain shuffling (U.S. Pat. No. 5,565,332), and techniques disclosed in, e.g., U.S. Pat. Nos. 6,407,213, 5,766,886, WO 9317105, Tan et al., J. Immunol. 169:1119 25 (2002), Caldas et al., Protein Eng. 13(5):353-60 (2000), Morea et al., Methods 20(3):267 79 (2000), Baca et al., J. Biol. Chem. 272(16):10678-84 (1997), Roguska et al., Protein Eng. 9(10):895 904 (1996), Couto et al., Cancer Res. 55 (23 Supp):5973s-5977s (1995), Couto et al., Cancer Res. 55(8):1717-22 (1995), Sandhu J S, Gene 150(2):409-10 (1994), and Pedersen et al., J. Mol. Biol. 235(3):959-73 (1994). See also U.S. Patent Pub. No. US 2005/0042664 A1 (Feb. 24, 2005), which is incorporated by reference herein in its entirety. Often, framework residues in the framework regions will be substituted with the corresponding residue from the CDR donor antibody to alter (e.g., improve) antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Reichmann et al., 1988, Nature 332:323, which are incorporated herein by reference in their entireties.)

Single domain antibodies, for example, antibodies lacking the light chains, can be produced by methods well-known in the art. See Riechmann et al., 1999, J. Immunol. 231:25-38; Nuttall et al., 2000, Curr. Pharm. Biotechnol. 1(3):253-263; Muylderman, 2001, J. Biotechnol. 74(4):277302; U.S. Pat. No. 6,005,079; and International Publication Nos. WO 94/04678, WO 94/25591, and WO 01/44301, each of which is incorporated by reference herein in its entirety.

Further, the antibodies that bind to a C10orf54 antigen can, in turn, be utilized to generate anti-idiotype antibodies that "mimic" an antigen using techniques well known to those skilled in the art. (See, e.g., Greenspan & Bona, 1989, FASEB J. 7(5):437-444; and Nissinoff, 1991, J. Immunol. 147(8):2429-2438).

Polynucleotides Encoding an Antibody

Also provided herein are polynucleotides comprising a nucleotide sequence encoding an antibody provided herein that binds to C10orf54 (e.g., C10orf54 polypeptide, C10orf54 polypeptide fragment, C10orf54 epitope). Also provided herein are polynucleotides that hybridize under high stringency, intermediate or lower stringency hybridization conditions, e.g., as defined supra, to polynucleotides that encode a antibody or modified antibody provided herein.

In certain embodiments, nucleic acid molecules provided herein comprise or consist of a nucleic acid sequence encoding a VH and/or VL amino acid sequence disclosed herein, or any combination thereof (e.g., as a nucleotide sequence encoding an antibody provided herein, such as a full-length antibody, heavy and/or light chain of an antibody, or a single chain antibody provided herein).

Recombinant Expression of an Antibody

Recombinant expression of an antibody provided herein (e.g., a full-length antibody, heavy and/or light chain of an antibody, or a single chain antibody provided herein) that binds to a C10orf54 antigen requires construction of an expression vector containing a polynucleotide that encodes the antibody. Once a polynucleotide encoding an antibody molecule, heavy or light chain of an antibody, or fragment thereof (such as that containing the heavy and/or light chain variable domain) has been obtained, the vector for the production of the antibody molecule may be produced by recombinant DNA technology using techniques well-known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. Thus, also provided herein are replicable vectors comprising a nucleotide sequence encoding an antibody molecule provided herein, a heavy or light chain of an antibody, a heavy or light chain variable domain of an antibody or a fragment thereof, or a heavy or light chain CDR, operably linked to a promoter. Such vectors may include the nucleotide sequence encoding the constant region of the antibody molecule (see, e.g., International Publication Nos. WO 86/05807 and WO 89/01036; and U.S. Pat. No. 5,122,464) and the variable domain of the antibody may be cloned into such a vector for expression of the entire heavy, the entire light chain, or both the entire heavy and light chains.

The expression vector is transferred to a host cell by conventional techniques and the transfected cells are then cultured by conventional techniques to produce an antibody provided herein. Thus, also provided herein are host cells containing a polynucleotide encoding an antibody provided herein or fragments thereof, or a heavy or light chain thereof, or fragment thereof, or a single chain antibody provided herein, operably linked to a heterologous promoter. In certain embodiments for the expression of double-chained antibodies, vectors encoding both the heavy and light chains may be co-expressed in the host cell for expression of the entire immunoglobulin molecule, as detailed below.

A variety of host-expression vector systems may be utilized to express the antibodies provided herein (see, e.g., U.S. Pat. No. 5,807,715). Such host-expression systems represent vehicles by which the coding sequences of interest may be produced and subsequently purified, but also represent cells which may, when transformed or transfected with the appropriate nucleotide coding sequences, express an antibody provided herein in situ. These include but are not limited to microorganisms such as bacteria (e.g., *E. coli* and *B. subtilis*) transformed with recombinant bacteriophage DNA, plasmid DNA or cosmid DNA expression vectors containing antibody coding sequences; yeast (e.g., *Saccharomyces Pichia*) transformed with recombinant yeast expression vectors containing antibody coding sequences; insect cell systems infected with recombinant virus expression vectors (e.g., baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, NS0, and 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). In certain embodiments, bacterial cells, such as *Escherichia coli*, or eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., 1986, Gene 45:101; and Cockett et al., 1990, Bio/Technology 8:2). In specific embodiments, antibodies provided herein are produced in CHO cells. In a specific embodiment, the expression of nucleotide sequences encoding antibodies provided herein which bind to a C10orf54 antigen is regulated by a constitutive promoter, inducible promoter or tissue specific promoter.

In bacterial systems, a number of expression vectors may be advantageously selected depending upon the use intended for the antibody molecule being expressed. For example, when a large quantity of such an antibody is to be produced, for the generation of pharmaceutical compositions of an antibody molecule, vectors which direct the expression of high levels of fusion protein products that are readily purified may be desirable. Such vectors include, but are not limited to, the *E. coli* expression vector pUR278 (Ruther et al., 1983, EMBO 12:1791), in which the antibody coding sequence may be ligated individually into the vector in frame with the lac Z coding region so that a fusion protein is produced; pIN vectors (Inouye & Inouye, 1985, Nucleic Acids Res. 13:3101-3109; Van Heeke & Schuster, 1989, J. Biol. Chem. 24:5503-5509); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or factor Xa protease cleavage sites so that the cloned target gene product can be released from the GST moiety.

In an insect system, *Autographa califomica* nuclear polyhedrosis virus (AcNPV) is used as a vector to express foreign genes. The virus grows in *Spodoptera frugiperda* cells. The antibody coding sequence may be cloned individually into non-essential regions (for example the polyhedrin gene) of the virus and placed under control of an AcNPV promoter (for example the polyhedrin promoter).

In mammalian host cells, a number of viral-based expression systems may be utilized. In cases where an adenovirus is used as an expression vector, the antibody coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region El or E3) will result in a recombinant virus that is viable and capable of expressing the antibody molecule in infected hosts (e.g., see Logan & Shenk, 1984, Proc. Natl. Acad. Sci. USA 8 1:355-359). Specific initiation signals may also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see, e.g., Bittner et al., 1987, Methods in Enzymol. 153:51-544).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include but are not limited to CHO, VERY, BHK, Hela, COS, MDCK, 293, 3T3, W138, BT483, Hs578T, HTB2, BT2O and T47D, NS0 (a murine myeloma cell line that does not endogenously produce any immunoglobulin chains), CRL7O3O and HsS78Bst cells. In specific embodiments, fully human, monoclonal anti-C10orf54 antibodies provided herein are produced in mammalian cells, such as CHO cells.

For long-term, high-yield production of recombinant proteins, stable expression is useful, but not mandatory. For example, cell lines which stably express the antibody molecule may be engineered. Rather than using expression vectors which contain viral origins of replication, host cells can be transformed with DNA controlled by appropriate expression control elements (e.g., promoter, enhancer, sequences, transcription terminators, polyadenylation sites, etc.), and a selectable marker.

Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compositions that interact directly or indirectly with the antibody molecule.

A number of selection systems may be used, including but not limited to, the herpes simplex virus thymidine kinase (Wigler et al., 1977, Cell 11:223), hypoxanthineguanine phosphoribosyltransferase (Szybalska & Szybalski, 1992, Proc. Natl. Acad. Sci. USA 48:202), and adenine phosphoribosyltransferase (Lowy et al., 1980, Cell 22:8-17) genes can be employed in tk-, hgprt- or aprt-cells, respectively. Also, antimetabolite resistance can be used as the basis of selection for the following genes: dhfr, which confers resistance to methotrexate (Wigler et al., 1980, Natl. Acad. Sci. USA 77:357; O'Hare et al., 1981, Proc. Natl. Acad. Sci. USA 78:1527); gpt, which confers resistance to mycophenolic acid (Mulligan & Berg, 1981, Proc. Natl. Acad. Sci. USA 78:2072); neo, which confers resistance to the aminoglycoside G-418 (Wu and Wu, 1991, Biotherapy 3:87-95; Tolstoshev, 1993, Ann. Rev. Pharmacol. Toxicol. 32:573-596; Mulligan, 1993, Science 260:926-932; and Morgan and Anderson, 1993, Ann. Rev. Biochem. 62:191-217; May, 1993, TIB TECH 11(5):155-2 15); and hygro, which confers resistance to hygromycin (Santerre et al., 1984, Gene 30:147). Methods commonly known in the art of recombinant DNA technology may be routinely applied to select the desired recombinant clone, and such methods are described, for example, in Ausubel et al. (eds.), *Current Protocols in Molecular Biology*, John Wiley & Sons, NY (1993); Kriegler, *Gene Transfer and Expression*, A Laboratory Manual, Stockton Press, NY (1990); and in Chapters 12 and 13, Dracopoli et al. (eds.), *Current Protocols in Human Genetics*, John Wiley & Sons, NY (1994); Colberre-Garapin et al., 1981, J. Mol. Biol. 150:1, which are incorporated by reference herein in their entireties.

The expression levels of an antibody molecule can be increased by vector amplification (for a review, see Bebington and Hentschel, The use of vectors based on gene amplification for the expression of cloned genes in mammalian cells in DNA cloning, Vol. 3 (Academic Press, New York, 1987)). When a marker in the vector system expressing antibody is amplifiable, increase in the level of inhibitor present in culture of host cell will increase the number of copies of the marker gene. Since the amplified region is associated with the antibody gene, production of the antibody will also increase (Crouse et al., 1983, Mol. Cell. Biol. 3:257).

The host cell may be co-transfected with two expression vectors provided herein, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain should be placed before the heavy chain to avoid an excess of toxic free heavy chain (Proudfoot, 1986, Nature 322:52; and Kohler, 1980, Proc. Natl. Acad. Sci. USA 77:2197-2199). The coding sequences for the heavy and light chains may comprise cDNA or genomic DNA.

Once an antibody has been produced by recombinant expression, it may be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. Further, the antibodies provided herein may be fused to heterologous polypeptide sequences described herein or otherwise known in the art to facilitate purification.

Kits

Also provided herein is a pharmaceutical pack or kit comprising one or more containers filled with one or more of the ingredients of the pharmaceutical compositions provided herein, such as one or more antibodies provided herein. Optionally associated with such container(s) can be a notice in the form prescribed by a governmental agency regulating the manufacture, use or sale of pharmaceuticals or biological products, which notice reflects approval by the agency of manufacture, use or sale for human administration. In some embodiments, the kit comprises a package insert. The term "package insert" is used to refer to instructions customarily included in commercial packages of therapeutic products, that contain information about the indications, usage, dosage, administration, contraindications and/or warnings concerning the use of such therapeutic products, as well as instructions for use.

Also provided herein are kits that can be used in the above methods. In one embodiment, a kit comprises an antibody provided herein, such as an isolated antibody, in one or more containers. In a specific embodiment, the kits provided herein contain a substantially isolated C10orf54 antigen as a control. In certain embodiments, the kits provided herein further comprise a control antibody which does not react with the C10orf54 antigen. In another specific embodiment, the kits provided herein contain a means for detecting the binding of a modified antibody to a C10orf54 antigen (e.g., the antibody may be conjugated to a detectable substrate such as a fluorescent compound, an enzymatic substrate, a radioactive compound or a luminescent compound, or a second antibody which recognizes the first antibody may be conjugated to a detectable substrate). In specific embodiments, the kit may include a recombinantly produced or chemically synthesized C10orf54 antigen. The C10orf54 antigen provided in the kit may also be attached to a solid support. In a more specific embodiment the detecting means of the above described kit includes a solid support to which C10orf54 antigen is attached. Such a kit may also include a non-attached reporter-labeled anti-human antibody. In this embodiment, binding of the antibody to the C10orf54 antigen can be detected by binding of the the reporter-labeled antibody.

The following examples are offered by way of illustration, and not by way of limitation.

EXAMPLES

Example 1—Identification of C10ORF54 on the Surface of Acute Myelogenous Leukemia (AML) Tumor Cells A total of 14 fresh bone marrow mononuclear cells (BMMCs) from patients with AML were obtained from AllCells and additional 16 frozen patient samples were from Fred Hutchinson Cancer Research Center (FHCRC). As a control, 16 fresh BMMC samples from healthy donors were analyzed. To monitor the quality of individual AML samples, hematoxylin and eosin staining of AML blasts were performed or AML marker expression was monitored using flow cytometry/FACS analysis. Sample handling was optimized so as to maximally maintain cell viability during sample isolation. Optimal labeling times for AML samples were determined to allow for efficient labeling without compromise of cellular integrity.

Surface tagged antigen profiling (sTAg) was used to identify and quantitatively profile the repertoire of surface proteins on cells in the samples. The extracellular domains of proteins associated with the cell membranes of intact primary AML tumor cells were chemically tagged and then chromatographically enriched for tagged proteins using a solid-phase affinity resin. Eluted proteins were stored at −80° C. prior to mass spectrometry analysis as described below.

Proteins enriched by the sTAg method were identified and quantified using high-resolution, shotgun liquid chromatography tandem mass spectrometry (MS). A hybrid Thermo-Fisher LTQ-ORBITRAP VELOS mass spectrometer, which combines the sensitivity of a linear ion trap with the high-resolution and mass accuracy afforded by the revolutionary orbitrap mass analyzer (Olsen et al., Mol. Cell Proteomics 8:2759-2769, 2009) coupled to a nanoflow liquid chromatography apparatus was employed for shotgun-based, bottoms-up proteomics to determine the identities and quantitative abundance measurements of proteins in the AML cell surface enrichment fractions (Yates et al., Annu. Rev. Biomed. Eng. 11:49-79, 2009). Tryptic digests from enriched surface proteins were separated by hydrophobicity via online, nanoflow liquid chromatography as peptide masses and fragmentation patterns were recorded dynamically by the mass spectrometer. To determine peptide and protein identities, the raw MS data were processed using the SEQUEST algorithm executed on a fast-processing Sorcerer 2 platform (Lundgren et al., Curr. Protoc. Bioinformatics, Chapter 13: Unit 13.3, 2009), to determine best-fit matches between experimental fragmentation patterns and those determined in-silico from the human proteome. Resulting matches were statistically validated using the PEPTIDEPROPHET (Keller et al., Anal. Chem. 74:5383-5392, 2002) and PROTEINPROPHET (Nesvizhskii et al., Anal. Chem. 75: 4646-4658, 2003) algorithms as implemented in SCAFFOLD Software (Proteome Software) to ensure the lowest possible false discovery rates (FDR) and thus inclusion of only robustly identified proteins in the candidate pool.

The relative quantitative levels of identified proteins in the sTAg samples were determined using the spectral counting method (reviewed in Neilson et al., Proteomics 11:535-553, 2011). Spectral counting is based on the empirical demonstration that the number of assigned (positively identified) spectra associated with peptides from each protein correlates strongly with that protein's relative abundance in the original mixture (Liu et al., Anal. Chem. 76:4193-4201, 2004). Spectral counts of identified peptides were obtained from the SCAFFOLD Software program that displays, sorts and filters the results of SEQUEST-searched mass spectrometry data. Raw spectral counts were transformed to percent Normalized Spectral Abundance Factor (% NSAF) values (Zybailov et al., J. Proteome Res. 5:2339-2347, 2006) to account for differences in protein length and variability in total protein concentration. Selected monoclonal antibodies were used to validate the proteomic measurements using quantitative FACS analysis as an independent, external confirmatory measure of the sTAg mass spectrometry-based proteomic profiling of the primary tumor cell surface expression (see, e.g., Example 2).

Figure 1B:
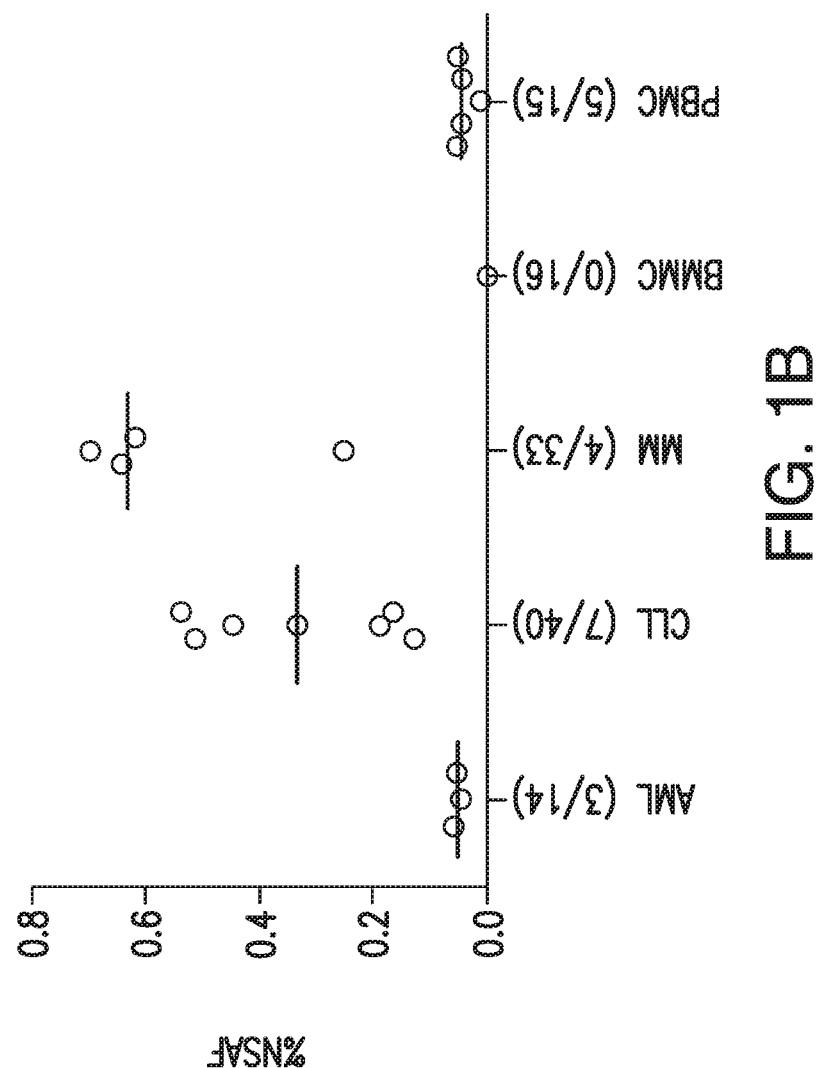

Using sTAg analysis, C10orf54 having the amino acid sequence of SEQ ID NO:1080 was identified as being present on the surface of AML tumor cells. As shown in FIG. 1A, the sTAg method identified C10orf54 in 7 of 30 primary AML samples with a median % NSAF of 0.06. In contrast, C10orf54 was not detected in any 16 BMMC samples from healthy donors. The AML benchmark, CD33, was identified in 11 of 30 AML samples with a median % NSAF of 0.07, and four of 16 normal BMMC samples with a median % NSAF of 0.05. FIG. 1B, shows a subset of the sTAg samples shown in FIG. 1A. Based on this analysis, C10orf54 appears to be comparably expressed to CD33 in patient-derived AML specimens and expressed on a significant portion of AML patients relative to relevant normal controls.

Example 2—Expression of C10ORF54

A. Expression in AML Flow cytometry studies were conducted with 23 primary and 3 normal BM-MNC samples obtained as described in Example 1 using anti-C10orf54 antibodies to analyze the expression profile of C10orf54 in AML. Antibodies were labeled with AF647 or AF488 fluorochromes. Cells were counted and used at 500000 cells/stain, resuspended in FACS buffer: RPMI, 4% HIFBS, 0.02% NaN3. Antibodies were incubated for 15 minutes, at room temperature in the dark and then analyzed on a MACSQuant (Miltenyl Biotec, Auburn, Calif.) instrument. Data analysis was performed using the FLOWJO (TreeStar, Ashland, Oreg.) software. Results of FACS analysis using anti-C10orf54 antibody 76E1 are shown in FIG. 2.

B. Expression in Normal vs. Tumor Tissues

Tissue microarray (TMA) studies were conducted to determine the protein expression for C10orf54 in a variety of human normal and tumor tissues.

A variety of formalin fixed paraffin embedded tissues, including TMAs obtained from US Biomax (Rockville, Md.) and Protein Biotechnologies (Ramona, Calif.), were used. Formalin fixed paraffin embedded sarcoma cells transfected with C10orf54, sarcoma parental cells and human placenta cells were used as positive and negative controls. An anti-C10orf54 antibody (Novus Biologicals (Littleton C080120) Cat # NBP1-88967 C10orf54/B7-H5/PD-1H) was used at a dilution of 1:150 with citrate buffer pH6.0 for antigen retrieval.

The immunohistochemistry staining was performed using a Dako Autostainer (Dako North America, Carpenteria, Calif. 93013) at room temperature with PBS washes between each step.

Normal tissue C10orf54 expression was primarily confined to immune cells in most normal tissues evaluated. C10orf54 positive blood vessels were observed in CNS tissues although at higher magnification, and C10orf54 expression appeared to be on perivascular cells (pericytes) and immune cells. Trophoblasts in the placenta were strongly positive for C10orf54. The only epithelial tissue where C10orf54 positive expression was observed was in the reactive tonsil. However, this positive expression may be due to the large numbers of positive lymphocytes trafficking through the epithelium. Negative tissues included kidney glomeruli, tubules and ducts, liver hepatocytes and sinusoids, lung alveoli and bronchi, pancreas islets and acini, heart muscle, prostate glands, ovary, colon crypts, stomach glands and epithelia, skin glands and epithelia, thymus, uterus, adrenal glands, skeletal muscle, CNS neurons, bladder epithelia, and large vessels.

Thus, in summary, the normal tissue TMA studies showed the strongest positive staining for placenta trophoblasts, with positive immune cells in small intestine (lamina propria), spleen, tonsil, ureter and lung.

The tumor tissue TMA studies surprisingly showed C10orf54 positive cells present in more than 99% of tumors having inflammation. These results are summarized in Table 34.

TABLE 34

| ORGAN | TUMOR TYPE | N No Inflammation | N Inflammation Present | INFLAMMATION/ C10orf54 POSITIVE CELLS |
|---|---|---|---|---|
| SKIN | Melanoma Primary | 31 | 9 | 9/9 |
| | Melanoma Metastatic | 9 | 5 | 5/5 |
| | Melanoma Benign | 23 | 0 | N/A* |
| | Squamous Cell | 0 | 2 | 2/2 |
| COLON | Adenocarcinoma | 1 | 9 | 9/9 |
| BREAST | Ductal | 5 | 4 | 4/4 |
| LIVER | Hepatocellular | 7 | 1 | 1/1 |
| BLADDER | Transitional Cell | 3 | 2 | 2/2 |
| KIDNEY | Clear Cell | 5 | 0 | N/A* |
| LUNG | Squamous Cell | 0 | 5 | 5/5 |
| | Adenocarcinoma | 2 | 2 | 2/2 |
| | Small Cell** | 0 | 1 | 0/1 |
| STOMACH | Adenocarcinoma | 2 | 2 | 2/2 |
| PANCREAS | Adenocarcinoma | 0 | 2 | 2/2 |
| ESOPHAGUS | Squamous Cell | 0 | 2 | 2/2 |

N/A*—not applicable as no inflammation present.
**Small cell lung cancer sample had inflammation that was negative for C10orf54.

Thus, in summary, C10orf54 expression in tumor tissue was localized within the inflammatory immune cells in many types of tumors.

C. Expression in Myeloid Derived Suppressor Cells (MDSC)

Flow cytometry studies were conducted as described below to determine C10orf54 expression levels in the MDSC sub-population (CD11b$^+$ leukocytes) of purified human peripheral blood mononuclear cells (PBMCs) from healthy donors. Expression was assessed and quantified using labeled monoclonal antibody 76E1 in the following MDSC populations: monocytic (CD11b$^+$/CD14$^+$/HLA-DR$^-$), granulocytic (CD11b$^+$/CD15$^+$/HLA-DR$^-$), and immature myeloid cells (CD11b$^+$/CD15$^-$/HLA-DR$^-$). The PBMC samples used in these experiments were obtained from ALLCELLS (Emeryville, Calif.).

The antibody clone 76E1 was labeled with Alexa Fluor 647. PBMC samples were prepared and labeled with LIVE/DEAD Yellow (LDY). 100 µl (1E6 cells) were added to the following: FcR Blocking Reagent, human; Lineage markers; CD11b-PE; CD14-APC-Cy7; CD15-PerCP-Cy5.5; HLA-DR-PE-Cy7; and 1 µg of labeled 76E1-AF647 antibody. After incubation for 30 minutes at 4° C. in the dark, samples were washed and analyzed.

Median Fluorescence Intensities (MFI) was calculated for each sample on a MACSQuant Analyzer. In order to determine C10orf54 copy numbers, Quantum Simply Cellular anti-Mouse IgG kit (Bangs Laboratories, 815B) was used.

Figures 26A, 26B:
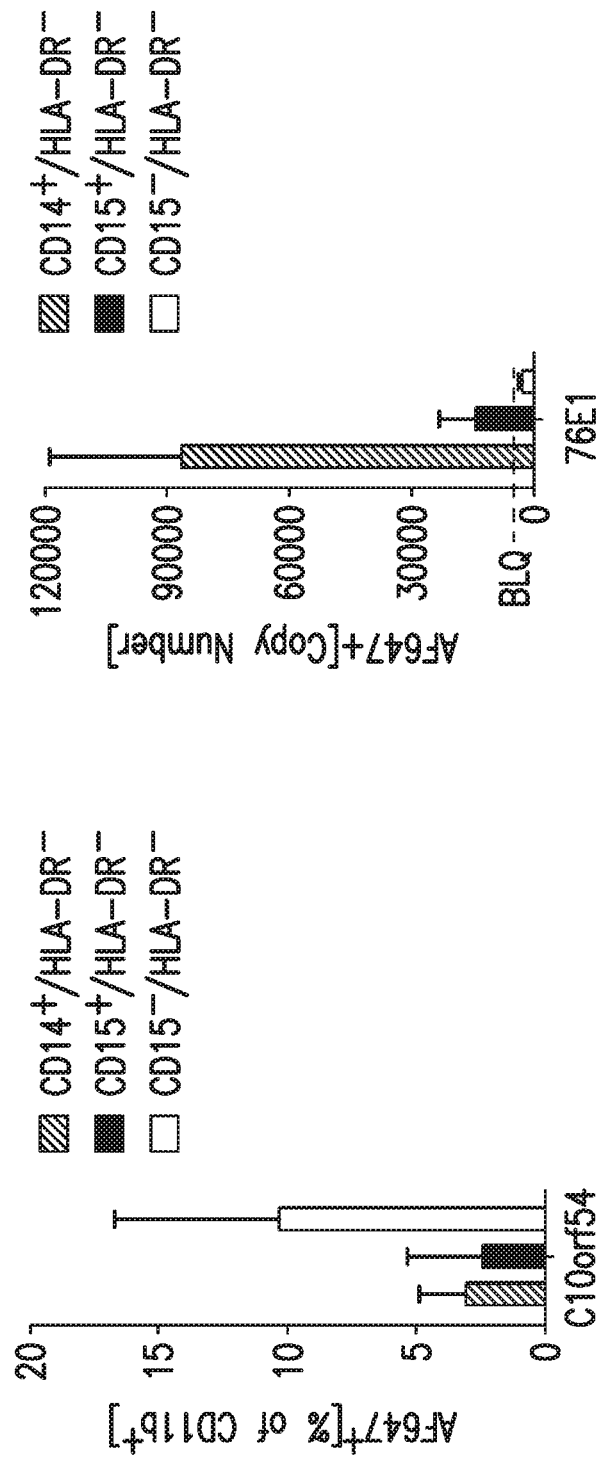
FIGS. 26A and 26B show C10orf54 expression in MDSC sub-populations.

The percentage of 76E1-AF-647$^+$ cells found within the three MDSC sub-populations are summarized in FIG. 26A. Similarly, the C10orf54 copy numbers for each MDSC subpopulation are summarized in FIG. 26B.

Using the above analysis, it was possible to identify both the Lin$^-$/CD11b$^+$ leukocytes and MDSC subpopulations, which showed that the monocytic MDSC population exhibits the highest level of C10orf54 expression in healthy PBMC samples.

D. Expression in CD4$^+$/CD25$^+$ T-cells

Flow cytometry studies were conducted as described above to determine C10orf54 expression levels in naïve CD4$^+$/CD25$^+$ T-cells found in human PBMCs. As described above, expression was assessed and quantified using labeled monoclonal antibody 76E1. The CD4$^+$/CD25$^+$ T-cells were isolated using the human CD4+/CD25+ Regulatory T Cell Isolation Kit (Miltenyi-Biotec, 130-091-301). Aliquots from each stage of the separation (PBMC, CD4+ T-cells, CD4+/CD25+ T-cells) were analyzed for C10orf54 expression. MFI values were quantified using the Quantum Simply Cellular anti-Mouse IgG Kit (Bangs Laboratories, 815B). Human PBMC samples were obtained from ALLCELLS to assess this methodology.

The above analysis showed that C10orf54 was minimally expressed in CD4$^+$/CD25$^+$ T-cells.

E. Expression in Human Melanoma

Immunohistochemistry (IHC) staining and immunofluorescence (IF) double staining studies were conducted as described below to determine C10orf54 expression in human melanoma tumor samples and to evaluate a large number of cell subtypes (macrophages, myeloid cells, T-cells and tumor cells).

Three distinct melanomas were evaluated: two soft tissue skin melanomas (M113044 and OD41239) and one metastatic melanoma to the lymph node (WD-12972). One sample of soft tissue melanoma (OD41239) was >90% tumor while the other soft tissue melanoma and the melanoma met to the lymph node (LN) had a large inflammatory response with fewer tumor cells present.

The antibodies used in this study are outlined in Table 35 below. Gp100, which is preferentially expressed at high levels in melanoma cells, was also stained in each melanoma tissue using IHC to determine the amount of tumor cells within the tissue samples and the extent of C10orf54 positive tumor cells.

TABLE 35

| Primary Antibody | Company | Host | Clone | Dilution | Antibody Cat# | Secondary Antibody | Secondary Cat# * |
|---|---|---|---|---|---|---|---|
| CD3 | Abcam | Rabbit | Pab | 1:400 | ab5690 | anti-Rabbit-Cy3 | 711-165-152 |
| CD68 | Spring Bioscience | Rabbit | SP251 | 1:100 | M5510 | anti-Rabbit-Cy3 | 711-165-152 |
| CD11b | BioLegend | Rat | M1/70 | 5 ug/ml | 101202 | anti-Rat-Cy3 | 712-165-150 |
| PD-L1 | Spring Bioscience | Rabbit | SP142 | 1:150 | M4420 | anti-Rabbit-Cy3 | 711-165-152 |
| gp100 | Abcam | Rabbit | EPR4864 | 1:100 | ab137062 | anti-Rabbit-Cy3 | 711-165-152 |
| VISTA | Abgent | Mouse | Pab | 3 ug/ml | H0064115-P01 | anti-mouse-488 | 715-545-150 |

* Jackson ImmunoResearch Laboratories Inc

For IF double staining, 8 μm frozen cryostat sections were fixed in 75% 200 proof Ethanol and 25% Acetone for 5 minutes. A cocktail of primary antibodies (2 different species diluted in Dako diluent cat # S3022; diluted according to Table 35) were added to the samples and incubated for 1 hour. Secondary antibodies were then added at a ratio of 1:200 and incubated 30 mins. Coverslips with Prolong Gold+DAPI (ThermoFisher cat #36935) were added and left to cure overnight. An Olympus BX52 upright fluorescent microscope was used to analyze the samples.

For IHC staining with gp100 antibody, 8 μm frozen cryostat sections were fixed in 75% 200 proof Ethanol and 25% Acetone for 5 minutes. Endogenous peroxidase was blocked by incubation with Bloxall (Vector cat # SP-6000)) for 5 minutes. Samples were further blocked using Avidin and Biotin blocking kit (BioLegend cat # SIG-31126) for 10 mins each and Protein Block (Dako cat #0909) for 30 mins. Primary gp100 antibody (abcam cat # ab137062; ratio of 1:100) was added and incubated for 1 hour. Secondary antibody biotin anti-rabbit (Vector cat # BA1000) was added at a ratio of 1:200 and incubated for 30 mins. Streptavidin-HRP staining was performed using VECTASTAIN Elite ABC kit (Vector Laboratories cat # PK6100) for 30 mins. DAB (Sigma cat # D4418) staining and Mayers hematoxylin counterstain (EMS cat #26043-05) were also performed.

The following summarizes the results of the above experiments:

Gp100: Almost all the tumor cells in all three melanoma tissue samples were C10orf54 negative.

CD3: M113044: A large number of T-cells were very weakly C10orf54 positive. ~30% cells were C10orf54 positive/CD3 negative. OD41239: Very few T-cells present and almost all CD3 positive cells were C10orf54 negative. WD-12972: A large numbers of T-cells present. Many were also weakly C10orf54 positive. T-cells within the tumor were mostly C10orf54 negative and there were many C10orf54 positive cells that were CD3 negative throughout the tumor tissue.

CD68: M113044: Most CD68 positive cells were C10orf54 negative. OD41239: A subset of CD68 positive cells was also C10orf54 positive. WD-12972: CD68 positive cells were predominantly C10orf54 negative although there were also some CD68 negative/C10orf54 positive cells.

CD11b: Almost all CD11b positive cells were also C10orf54 positive. However, there were C10orf54 positive cells that were CD11 b negative in all three melanoma tumors.

PD-L1: PD-L1 positive cells were also predominantly C10orf54 positive in all three tumors. Again, there was C10orf54 positive cells that were PD-L1 negative in all three melanomas.

In summary, nearly all the gp100 positive melanoma tumor cells were C10orf54 negative in all three melanoma samples. There was a large variability in the amount of inflammatory cell infiltrate within the 3 different melanoma sample tissues. However, almost all the CD11 b and PD-L1 positive cells in these melanomas were C10orf54 positive and most CD3 positive T-cells were either C10orf54 negative or very weakly C10orf54 positive.

F. Expression in Non-Small Cell Lung Carcinoma (NSCLC)

Flow cytometry studies were conducted as described below to determine C10orf54 expression levels in PBMCs from NSCLC patients. Expression was assessed and quantified using labeled monoclonal antibody 26A to assess the sub-populations of CD11b, CD33, CD14 and CD15. Exemplary PBMC samples from a healthy patient and a clinically diagnosed NSCLC patient that were used in these studies were obtained from ALLCELLS (Emeryville, Calif.).

The antibody clone 26A was labeled with Alexa Fluor 647. PBMC samples were prepared. 100 μl (1E6 cells) were added to the following: FcR Blocking Reagent, human; Lineage markers; CD11 b-PE; CD14-APC-Cy7; CD15-PerCP-Cy5.5; HLA-DR-PE-Cy7; and 1 μg of labeled 26a-AF647 antibody. After incubation for 30 minutes at 4° C. in the dark, samples were washed, resuspended in DAPI working solution and analyzed.

Median Fluorescence Intensities (MFI) was calculated for each sample on a MACSQuant Analyzer. In order to determine C10orf54 copy numbers, Quantum Simply Cellular anti-Mouse IgG kit (Bangs Laboratories, 815B) was used.

Figure 27:
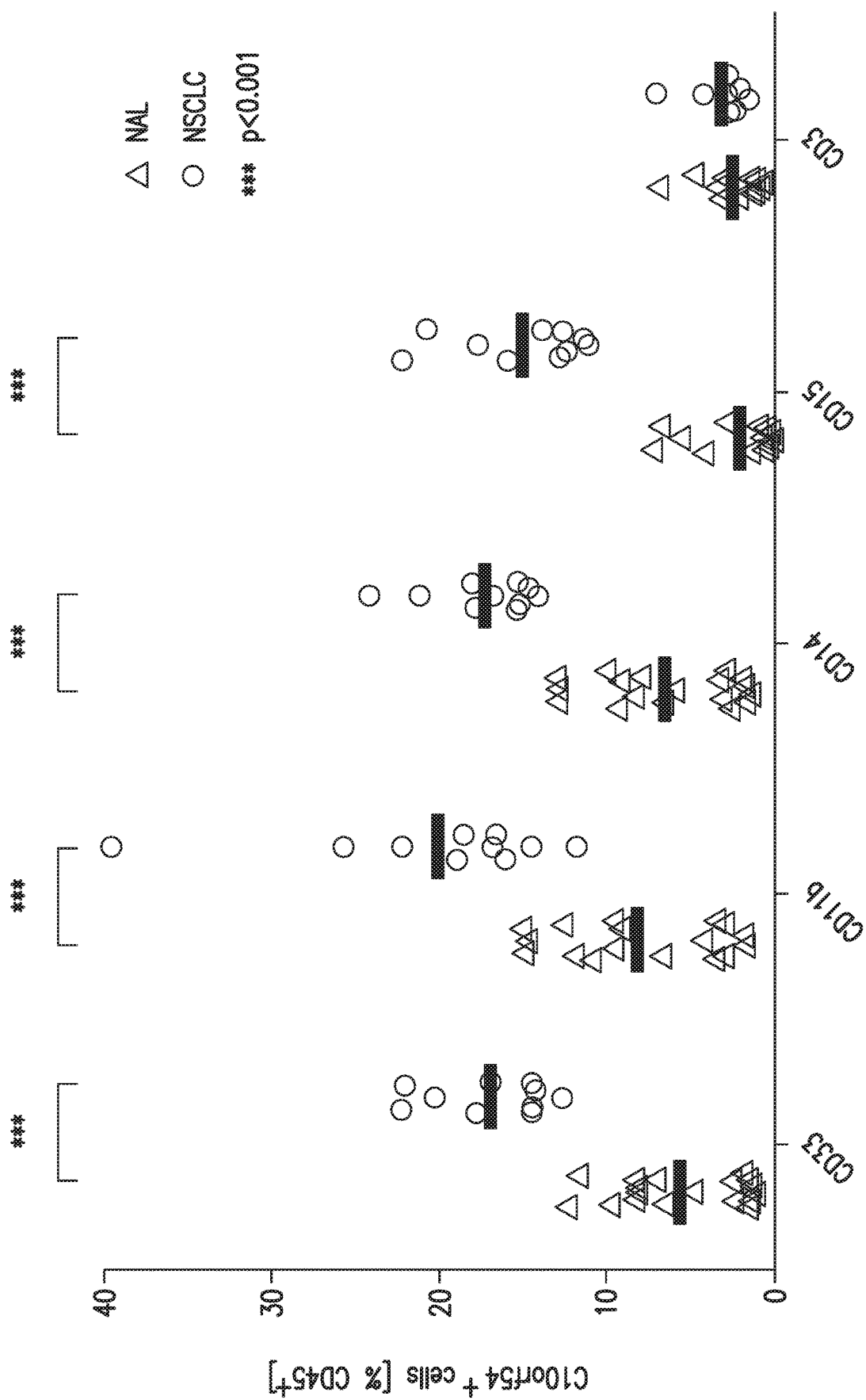
FIG. 27 shows a scatter plot of C10orf54 expression in PBMC subsets of NSCLC patients.

C10orf54 expression was elevated in the PBMC sub-populations from the NSCLC sample in comparison to the healthy sample as depicted in FIG. 27. These results are summarized in Table 36, which shows the C10orf54 copy numbers for expression within cell subsets.

TABLE 36

| | C10orf54 [Copy Numbers] | |
|---|---|---|
| Cell Subset | Healthy | NSCLC |
| CD11b | 102611 | 141143 |
| CD33 | 97087 | 183352 |
| CD14 | 102937 | 191727 |
| CD15 | 19388 | 60436 |

Additionally, tissue microarray (TMA) studies were conducted to determine the protein expression for C10orf54 in NSCLC.

A variety of formalin fixed paraffin embedded tissues, including TMAs obtained from US Biomax (Rockville, Md.), were used. Formalin fixed paraffin embedded sarcoma cells transfected with C10orf54 and sarcoma parental cells were used as positive and negative controls. An anti-C10orf54 antibody (Novus Biologicals (Littleton CO80120) Cat # NBP1-88967 C10orf54/B7-H5/PD-1H) was used at a dilution of 1:150 with citrate buffer pH6.0 for antigen retrieval.

The immunohistochemistry staining was performed using a Dako Autostainer (Dako North America, Carpenteria, Calif. 93013) at room temperature with PBS washes between each step.

A TMA of a lung tumor having all types of NSCLC tumors revealed that all the NSCLC types had positive C10orf54 expression. However, the sample numbers in this TMA were relatively small, except for the squamous cell carcinomas (SCC), which showed a strong C10orf54 expression pattern.

The SCC subtype was further evaluated in four additional TMAs. Two TMAs had additional survival data. However, no correlation was observed when this data was plotted against percentage of C10orf54 positive cells. One TMA also provided EGFR expression data, but no correlation was observed when plotted against percentage of C10orf54 positive cells. In this TMA, the number of samples may have been too low to determine a true correlation. Pooled data for all four SCC TMAs was also evaluated. The samples were separated according to the degree of inflammation present in the cores assayed. When no inflammation is observed, no C10orf54 positive cells were detected. However, surprisingly, in specimens with either mild or marked inflammation, the majority of these samples had C10orf54 positive infiltrating cells. For example, in one SCC TMA, 17% showed now inflammation, 28% showed mild inflammation and 55% showed moderate-marked inflammation. Of the 28% that showed mild inflammation, 85% were C10orf54-positive, and of the 55% that showed moderate-marked inflammation, 92% were C10orf54-positive.

Thus, the above analyses indicate an increased C10orf54 population within each subset relative to the healthy donor. Similarly, the C10orf54 copy numbers are higher in the samples from the NSCLC patient in comparison to the healthy donor. Moreover, NSCLC with inflammation strongly correlated with C10orf54 expression.

Example 3—Preparation of Monoclonal Antibodies to C10orf54

Antibodies to C10orf54 were generated using the iTAb platform. In this system, a mouse tumor cell line is transduced to stably express the human protein and then implanted subcutaneously in syngeneic mice. The mice are treated with anti-CD8 antibody to remove the cell mediated rejection pathway while leaving the humoral immune response intact. Following this immunization, splenocytes are harvested, and are fused to an immortalized partner cell to generate hybridomas. Antibodies from these hybridomas are screened in multiple assays designed to identify a diverse panel of antibodies with good binding properties. The selected antibodies are then produced for in vivo testing as follows.

Murine sarcoma cell lines that express C10orf54 were prepared by virus infection of sarcoma cell lines. A PCR-amplified C10orf54 gene was cloned into a murine stem cell virus expression vector with a neomycin resistance gene and sequenced to confirm the identity. To prepare virus particles, HEK 293t cells with retroviral packaging proteins were transfected, in the presence of transfection reagent FUGENE HD (Roche), with the retroviral expression vector containing C10orf54. The virus particles collected from the supernatant of the culture media 48 hours after transfection were used to infect the sarcoma cells. After G418 selection, stable transfectants were pooled and then cloned by limiting dilution. Clones were then picked and expanded in the presence of antibiotics. Clones with the highest expression level of C10orf54 as measured by flow cytometry were expanded and banked. These cell lines were then used to immunize the syngeneic mice for antibody production and in the binding assays for antibody selection as follows.

For immunization, the mouse sarcoma cell line that expresses C10orf54 was implanted subcutaneously in 129s6/SvEv mice, which are syngeneic with the sarcoma line. Mice were boosted with the cell line three days prior to spleen harvest. Splenocytes were isolated as single cells and fused with SP2-MIL6 cells using PEG1500. Resulting hybridomas were plated in 384-well plates and allowed to grow for ten days.

Antibodies against C10orf54 were initially selected using a cell-based enzyme-linked immunosorbant assay (ELISA) to detect binding to C10orf54. For this assay, the C10orf54 expressing sarcoma cells were plated in 384-well plates one day prior to assay. Cells were then treated with hybridoma supernatants. Following incubation and wash, the presence of bound antibody was detected using a peroxidase-conjugated goat anti-mouse IgG antibody (Jackson ImmunResearch Laboratories) followed by a chemiluminescent substrate (ThermoScientific SuperSignal ELISA Pico Substrate). Hybridomas identified as positive in the initial screen were transferred to the wells of a 96-well plate. After growth, the supernatants were tested in a similar assay for confirmation.

The isotype of the antibodies was identified by ELISA by using isotype specific goat anti-mouse Fc antibodies. For this assay, C10orf54 expressing cells were plated in 384-well plates one day prior to assay. Cells were then treated with hybridoma supernatants. Following incubation and wash, cells were incubated with peroxidase-conjugated goat antibody specific for mouse IgG1 or IgG2a (Jackson ImmunResearch Laboratories), followed by a chemiluminescent substrate (ThermoScientific SuperSignal ELISA Pico Substrate).

Concentration of antibody in supernatants found to be positive for binding to the C10orf54 expressing cells was measured by ELISA. Supernatants were tested at four dilutions. For each antibody, the dilution that generated a value within the linear range of the standard curve was used to calculate the concentration of the antibody in the supernatant. Antibody concentration in the supernatants ranged in concentration from >1 µg/ml to <500 µg/ml, with approximately 300 supernatants >10 µg/ml. Twenty-two monoclonal antibodies were selected for their binding to C10orf54 and further analyzed in vitro and in vivo as described herein.

The sequences for the selected twenty-two monoclonal antibodies (5B, 46A, 97A, 128A, 146C, 208A, 215A, 26A, 164A, 230A, 76E1, 53A, 259A, 33A, 39A, 124A, 175A, 321D, 141A, 51A, 353A, 305A) are shown below.

The nucleic acid and amino acid sequences for the heavy chain and light chain variable regions of the antibody 5B are shown below:

```
5B heavy chain variable region with signal
sequence
ATGGGTTGGAGCTGTATCATCTTCTTTCTGGTAGCAACAGCTACAGGTGT

GCACTCCCAGGTCCAGCTGCAGCAGTCTGGGGCTGAGCTGGTGAGGCCTG
```

```
GGGTCTCAGTGAAGATTTCCTGCAAGGGTTCTGGCTACACATTCACTGAT
TATGGTATGCACTGGGTGAAGCAGAGTCATGCAAAGAGTCTAGAGTGGAT
TGGAATTATTGATACTTACTATGGTGATGCTACCTACAACCAGAAGTTCA
AGGGCAAGGCCACGATGACTGTAGACAAATCCTCCAGCACAGCCTATATG
GAACTTGCCAGACTGACATCTGAGGATTCTGCCATCTATTACTGTGCAAG
AAGGGCTGGGAATGCTATGGACTACTGGGGTCAAGGAACCTCAGTCACCG
TCTCCTCA (SEQ ID NO: 1154)
MGWSCIIFFLVATATGVHSQVQLQQSGAELVRPGVSVKISCKGSGYTFTD
YGMHWVKQSHAKSLEWIGIIDTYYGDATYNQKFKGKATMTVDKSSSTAYM
ELARLTSEDSAIYYCARRAGNAMDYWGQGTSVTVSS (SEQ ID NO:
1155; Kabat CDRs are underlined; see also,
Table 12)

5B light chain variable region with signal
sequence
ATGAAGTCACAGACCCAGGTCTTCGTATTTCTACTGCTCTGTGTGTCTGG
TGCTCATGGGAATATTGTGATGACCCAGACTCCCAAATTCCTGCTTGTAT
CAGCAGGAGACAGGGTTACCATAACCTGCAAGGCCAGTCAGAGTGTGAGT
AATGATGTAGCTTGGTACCAACAGAAGCCAGGGCAGTCTCCTAAACTGCT
GATATACTATGCATCCAATCGCTACACTGGAGTCCCTGATCGCTTCACTG
GCAGTGGATATGGGACGGATTTCACTTTCACCATCAGCACTGTGCAGGCT
GAAGACCTGGCAGTTTATTTCTGTCAGCAGGATTATAGCTCTCCTCGGAC
GTTCGGTGGAGGCACCAAGCTGGAAATCAAA (SEQ ID NO: 1156)
MKSQTQVFVFLLLCVSGAHGNIVMTQTPKFLLVSAGDRVTITCKASQSVS
NDVAWYQQKPGQSPKLLIYYASNRYTGVPDRFTGSGYGTDFTFTISTVQA
EDLAVYFCQQDYSSPRTFGGGTKLEIK (SEQ ID NO: 1157;
Kabat CDRs are underlined; see also, Table 12)
```

The nucleic acid and amino acid sequences for the heavy chain and light chain variable regions of the antibody 46A are shown below:

```
46A heavy chain variable region with signal
sequence
ATGGGTTGGAGCTGTATCGTCTTCTTTCTGGTAGCAACAGCTACAGGTGT
GCACTCCCAGGTCCAGCTGCAGCAGGCCGGGGGTGAGCTGGTGAGGCCTG
GGGTCTCAGTGAAGATTTCCTGCAAGGGTTCTGGCTACACATTCACTGAT
TATGGTATGCACTGGGTGAAGCAGAGTCATGCAAAGAGTCTAGAGTGGAT
TGGAATTATTAATACTTACTATGGGGATGCTACCTACAACCAGAAGTTCA
AGGGCAAGGCCACAATGACTGTAGACAAATCCTCCAGCACAGCCTATATG
GAACTTGCCAGACTGACATCTGAGGATTCTGCCATCTATTACTGTGCAAG
AAGGGCTGGGACTGCTATGGACTACTGGGGTCAAGGAACCTCAGTCACCG
TCTCCTCA (SEQ ID NO: 1158)
MGWSCIVFFLVATATGVHSQVQLQQAGGELVRPGVSVKISCKGSGYTFTD
YGMHWVKQSHAKSLEWIGIINTYYGDATYNQKFKGKATMTVDKSSSTAYM
ELARLTSEDSAIYYCARRAGTAMDYWGQGTSVIVSS (SEQ ID NO:
1159; Kabat CDRs are underlined; see also,
Table 13)

46A light chain variable region with signal
sequence
ATGAAGTCACAGACCCAGGTCTTCGTATTTCTACTGCTCTGTGTGTCTGG
TGGTCATGGGAGTATTGTGATGACCCAGACTCCCAAATTCCTGCTTGTAT
CAGCAGGAGACAGGGTTACCATAACCTGCAAGGCCAGTCAGAGTGTGAGT
AATGATGTAGCTTGGTACCAACAGAAGCCAGGGCAGTCTCCTAAACTGCT
GATATACTATGCATCCAATCGCTACACTGGAGTCCCTGATCGCTTCACTG
GCAGTGGATATGGGACGGATTTCACTTTCACCATCAGCACTGTGCAGGCT
GAAGACCTGGCAGTTTATTTCTGTCAGCAGGATTATGGCTCTCCTCGGAC
GTTCGGTGGAGGCACCAAGCTGGAAATCAA (SEQ ID NO: 1160)
MKSQTQVFVFLLLCVSGGHGSIVMTQTPKFLLVSAGDRVTITCKASQSVS
NDVAWYQQKPGQSPKLLIYYASNRYTGVPDRFTGSGYGTDFTFTISTVQA
EDLAVYFCQQDYGSPRTFGGGTKLEIK (SEQ ID NO: 1161;
Kabat CDRs are underlined; see also, Table 13)
```

The nucleic acid and amino acid sequences for the heavy chain and light chain variable regions of the antibody 97A are shown below:

```
97A heavy chain variable region with signal
sequence
ATGGGTTGGAGCTGTATCATCTTCTTTCTGGTAGCAACAGCTACAGGTGT
GCACTCCCAGGTCCAGCTGCAGCAGTCTGGGGCTGAGCTGGTGAGGCCTG
GGGTCTCAGTGAAGATTTCCTGCAAGGGTTCTGGCTACACATTCACTGAT
TATGGTATGCACTGGGTGAAGCAGAGTCATGCAAAGAGTCTAGAGTGGAT
TGGAGTTATTGATACTTACTATGGTGATGCTAGTAACAACCAGAAGTTCA
AGGGCAAGGCCACAATGACTGTAGACAAATCCTCCAGCACAGCCTATATG
GAACTTGCCAGACTGACATCTGAGGATTCTGCCATCTATTACTGTGCAAG
AAGGGCTGGGAATGCTATGGACTACTGGGGTCAAGGAACCTCAGTCACCG
TCTCCTCA (SEQ ID NO: 1162)
MGWSCIIFFLVATATGVHSQVQLQQSGAELVRPGVSVKISCKGSGYTFTD
YGMHWVKQSHAKSLEWIGVIDTYYGDASNNQKFKGKATMTVDKSSSTAYM
ELARLTSEDSAIYYCARRAGNAMDYWGQGTSVTVSS (SEQ ID
NO: 1163; Kabat CDRs are underlined;
see also, Table 14)

97A light chain variable region with signal
sequence
ATGAAGTCACAGACCCAGGTCTTCGTATTTCTACTGCTCTGTGTGTCTGG
TGCTCATGGGAGTATTGTGATGACCCAGACTCCCAAATTCCTGCTTGTAT
CAGCAGGAGACAGGGTTGCCATAACCTGCAAGGCCAGTCAGAGTGTGAGT
AATGATGTAGCTTGGTACCAACAGAAGCCAGGGCAGTCTCCTAAACTGCT
GATATACTATGCATCCAATCGCTACACTGGAGTCCCTGATCGCTTCACTG
GCAGTGGATATGGGACGGATTTCACTTTCACCATCAGCACTGTGCAGGCT
```

```
GAAGACCTGGCAGTTTATTTCTGTCAGCAGGATTATGGCTCTCCTCGGAC

GTTCGGTGGAGGCACCAAGCTGGAAATCAAA (SEQ ID NO: 1164)

MKSQTQVFVFLLLCVSGAHGSIVMTQTPKFLLVSAGDRVAITCKASQSVS

NDVAWYQQKPGQSPKLLIYYASNRYTGVPDRFTGSGYGTDFTFTISTVQA

EDLAVYFCQQDYGSPRTFGGGTKLEIK (SEQ ID NO: 1165;

Kabat CDRs are underlined; see also, Table 14)
```

The nucleic acid and amino acid sequences for the heavy chain and light chain variable regions of the antibody 128A are shown below:

```
128A heavy chain variable region with signal
sequence
ATGGGTTGGAGCTGTATCATCTTCTTTCTGGTAGCAACAGCTACAGGTGT

GCACTCCCAGGTCCAGCTGCAGCAGTCTGGGGCTGAGCTGGTGAGGCCTG

GGGTCTCAGTGAAGATTTCCTGCAAGGGTTCTGGCTACACATTCACTGAT

TATGGTATGCACTGGGTGAAGCAGAGTCATGCAAAGAGTCTAGAGTGGAT

TGGACTTATTGATACTTACTATGGTGATGCTACCTACAACCACAAATTCA

AGGGCAAGGCCACGATGACTGTAGACAAATCCTCCAGAACAGCCTATATG

GAACTTGCCAGACTGACATCTGAGGATTCTGCCATCTATTACTGTGCAAG

AAGGGCTGGGAATGCTATGGACTACTGGGGTCAAGGAACCTCAGTCACCG

CCTCCTCA (SEQ ID NO: 1166)

MGWSCIIFFLVATATGVHSQVQLQQSGAELVRPGVSVKISCKGSGYTFTD

YGMHWVKQSHAKSLEWIGLIDTYYGDATYNHKFKGKATMTVDKSSRTAYM

ELARLTSEDSAIYYCARRAGNAMDYWGQGTSVTASS (SEQ ID

NO: 1167; Kabat CDRs are underlined; see also, Table 15)

128A light chain variable region with signal
sequence
ATGAAGTCACAGACCCAGGTCTTCGTATTTCTACTGCTCTGTGTGTCTGG

TACTCATGGGAATATTGCGATGACCCAGACTCCCAAATTCCTGCTTGTAT

CAGCAGGAGACAGGGTTACCATAACCTGCAAGGCCAGTCAGAGTGTGAGT

AATGATATAGCTTGGTACCAACAGAAGCCAGGACAGTCTCCTAGATTGCT

GATATACTATGCATCCAATCGCTACACTGGAGTCCCTGATCGCTTCACTG

GCAGTGGATATGGGACGGATTTCACTTTCACCATCAGCACTGTGCAGGCT

GAAGACCTGGCAGTTTATTTCTGTCAGCAGGATTATAGCTCTCCTCGGAC

GTTCGGTGGAGGCACCAAGCTGGAAATCAAA (SEQ ID NO: 1168)

MKSQTQVFVFLLLCVSGTHGNIAMTQTPKFLLVSAGDRVTITCKASQSVS

NDIAWYQQKPGQSPRLLIYYASNRYTGVPDRFTGSGYGTDFTFTISTVQA

EDLAVYFCQQDYSSPRTFGGGTKLEIK (SEQ ID NO: 1169;

Kabat CDRs are underlined; see also, Table 16)
```

The nucleic acid and amino acid sequences for the heavy chain and light chain variable regions of the antibody 146C are shown below:

```
146C heavy chain variable region with signal
sequence
ATGGGTTGGAGCTGTATCATCTTCTTTCTGGTAGCAACAGCTACAGGTGT

GCACTCCCAGGTCCAGCTGCAGCAGTCTGGGGCTGAGCTGGTGAGGCCTG

GGGTCTCAGTGAAGATTTCCTGCAAGGGTTCTGGCTACACATTCACTGAT

TATGGTATGCACTGGGTGAAGCAGAGTCATGCAAAGAGTCTAGAGTGGAT

TGGACTTATTGATACTTACTATGGTGATGCTACCTACAACCACAAATTCA

AGGGCAAGGCCACGATGACTGTAGACAAATCCTCCAGAACAGCCTATATG

GAACTTGCCAGACTGACATCTGAGGATTCTGCCATCTATTACTGTGCAAG

AAGGGCTGGGAATGCTATGGACTACTGGGGTCAAGGAACCTCAGTCACCG

CCTCCTCA (SEQ ID NO: 1170)

MGWSCIIFFLVATATGVHSQVQLQQSGAELVRPGVSVKISCKGSGYTFTD

YGMHWVKQSHAKSLEWIGLIDTYYGDATYNHKFKGKATMTVDKSSRTAYM

ELARLTSEDSAIYYCARRAGNAMDYWGQGTSVTASS (SEQ ID

NO: 1171; Kabat CDRs are underlined; see also, Table 16)

146C light chain variable region with signal
sequence
ATGAAGTCACAGACCCAGGTCTTCGTATTTCTACTGCTCTGTGTGTCTGG

TACTCATGGGAATATTGCGATGACCCAGACTCCCAAATTCCTGCTTGTAT

CAGCAGGAGACAGGGTTACCATAACCTGCAAGGCCAGTCAGAGTGTGAGT

AATGATATAGCTTGGTACCAACAGAAGCCAGGACAGTCTCCTAGATTGCT

GATATACTATGCATCCAATCGCTACACTGGAGTCCCTGATCGCTTCACTG

GCAGTGGATATGGGACGGATTTCACTTTCACCATCAGCACTGTGCAGGCT

GAAGACCTGGCAGTTTATTTCTGTCAGCAGGATTATAGCTCTCCTCGGAC

GTTCGGTGGAGGCACCAAGCTGGAAATCAAA (SEQ ID NO: 1172)

MKSQTQVFVFLLLCVSGTHGNIAMTQTPKFLLVSAGDRVTITCKASQSVS

NDIAWYQQKPGQSPRLLIYYASNRYTGVPDRFTGSGYGTDFTFTISTVQA

EDLAVYFCQQDYSSPRTFGGGTKLEIK (SEQ ID NO: 1173;

Kabat CDRs are underlined; see also, Table 16)
```

The nucleic acid and amino acid sequences for the heavy chain and light chain variable regions of the antibody 208A are shown below:

```
208A heavy chain variable region with signal
sequence
ATGGGTTGGAGCTGTATCATCTTCTTTCTGGTAGCAACAGCTACAGGTGT

GCACTCCCAGGTCCAGCTGCAGCAGTCTGGGGCTGAGCTGGTGAGGCCTG

GGGTCTCAGTGAAGATTTCCTGCAAGGGTTCTGGCTACACATTCACTGAT

TATGGTATGCACTGGGTGAAGCAGAGTCATGCAAAGAGTCTAGAGTGGAT

TGGAGTTATTGATACTTACTATGGTGATGCTGGCTACAACCAGAAGTTCA

AGGGCAAGGCCACAATGACTGTAGACAAATCCTCCAGCACAGCCTATATG

GAACTTGCCAGACTGACATCTGAGGATTCTGCCATCTATTACTGTGCAAG

AAGGGCTGGAAATGCTATGGACTACTGGGGTCAAGGAACCTCAGTCACCG

TCTCCTCA (SEQ ID NO: 1174)
```

MGWSCIIFFLVATATGVHSQVQLQQSGAELVRPGVSVKISCKGSGYTFT<u>D</u>

<u>YGMH</u>WVKQSHAKSLEWIG<u>VIDTYYGDAGYNQKFKG</u>KATMTVDKSSSTAYM

ELARLTSEDSAIYYCAR<u>RAGNAMDY</u>WGQGTSVTVSS (SEQ ID

NO: 1175; Kabat CDRs are underlined; see also, Table 17)

208A light chain variable region with signal
sequence
ATGAAGTCACAGACCCAGGTCTTCGTATTTCTACTGCTCTGTGTGTCTGG

TGCTCTTGGGAGTATTGTGATGACCCAGACTCCCAAATTCCTGCTTGTAT

CAGCAGGAGACAGGGTCACCATAACCTGCAAGGCCAGTCAGAGTGTGAGT

AATGATGTTGCTTGGTACCAACAGAAGCCAGGGCAGTCTCCTAAACTGCT

GATATACTATGCATCCAATCGCTACACTGGAGTCCCTGATCGCTTCACTG

GCAGTGGATATGGGACGGATTTCACTTTCACCATCAGCACTGTGCAGGCT

GAGGACCTGGCAGTTTATTTCTGTCAGCAGGATTATAGCTCTCCTCGGAC

GTTCGGTGGAGGCACCAAGCTGGAAATCAAA (SEQ ID NO: 1176)

MKSQTQVFVFLLLCVSGALGSIVMTQTPKFLLVSAGDRVTITC<u>KASQSVS</u>

<u>NDVA</u>WYQQKPGQSPKLLIY<u>YASNRYT</u>GVPDRFTGSGYGTDFTFTISTVQA

EDLAVYFC<u>QQDYSSPRT</u>FGGGTKLEIK (SEQ ID NO: 1177;

Kabat CDRs are underlined; see also, Table 17)

The nucleic acid and amino acid sequences for the heavy chain and light chain variable regions of the antibody 215A are shown below:

215A heavy chain variable region with signal
sequence
ATGGGATGGAGCTGGATCTTTCTCTTCCTCCTGTCAGGAACTGCAGGTGT

CCACTCTGAGGTCCAGCTGCAGCAGTCTGGACCTGAGTTGGTGAAGCCTG

GTGCTTCAATGAAGATATCCTGCAAGGCTTCTGGTTTCTCTTTCACTGGC

TACACCATGAACTGGGTGAAGCAGAGCCATGGAAAGAACCTTGAGTGGAT

TGGACTTATTAGTCCTTACAATGGTGGTACTAGCTACAACCAGAAGTTCA

AGGGCAAGGCCACATTAACTGTAGATAAGTCATCCAGCACAGCCTACATG

GAGCTCCTCAGTCTGACATCTGAGGACTCTGCAGTCTATTACTGTGCAAG

AAGGGCCTACGGCTATGCTATGGACTACTGGGGTCAAGGAACCTCAGTCA

CCGTCTCCTCA (SEQ ID NO: 1178)

MGWSWIFLFLLSGTAGVHSEVQLQQSGPELVKPGASMKISCKASGFSFT<u>G</u>

<u>YTMN</u>WVKQSHGKNLEWIG<u>LISPYNGGTSYNQKFKG</u>KATLTVDKSSSTAYM

ELLSLTSEDSAVYYCAR<u>RAYGYAMDY</u>WGQGTSVTVSS (SEQ ID

NO: 1179; Kabat CDRs are underlined; see also, Table 18)

215A light chain variable region with signal
sequence
ATGGATTTTCAAGTGCAGATTTTCAGCTTCCTGCTAATCAGTGCCTCAGT

CATACTGTCCAGAGGACAAATTGTTCTCACCCAGTCTCCAGCAATCATGT

CTGCATCTCCAGGGGAGAAGGTCACCATGACCTGCAGTGCCAGCTCAAGT

GTAAGTTACATGTTCTGGTACCAGCAGAAGCCAGGATCCTCCCCCAGACT

CCTGATTTATGACACATCCAACCTGGCTTCTGGAGTCCCTCTTCGCTTCA

GTGGCAGTGGGTCTGGGACCTCTTACTCTCTCACAATCAGCCGAATGGAG

GCTGAGGATGCTGCCACTTATTACTGCCAGCAGTGGAGTAGTTACCCATT

CACGTTCGGCTCGGGGACAAAGTTGGAAATAAAA (SEQ ID

NO: 1180)

MDFQVQIFSFLLISASVILSRGQIVLTQSPAIMSASPGEKVTMTC<u>SASSS</u>

<u>VSYMF</u>WYQQKPGSSPRLLIY<u>DTSNLAS</u>GVPLRFSGSGSGTSYSLTISRME

AEDAATYYC<u>QQWSSYPFT</u>FGSGTKLEIK (SEQ ID NO: 1181;

Kabat CDRs are underlined; see also, Table 18)

The nucleic acid and amino acid sequences for the heavy chain and light chain variable regions of the antibody 26A are shown below:

26A heavy chain variable region with signal
sequence
ATGGGATGGAGCTGGATCTTTCTCTTCCTCCTGTCAGGAACTGCAGGTGT

CCACTCTGAGGTCCAGCTGCAGCAGTCTGGACCTGAGCTGGTGAAGCCTG

GTGCTTCAATGAAGATATCCTGCAAGGCTTCTGGTTTCTCATTCACTGGC

TACACCATGAACTGGGTGAAGCAGAGCCATGTAAAGAACCTTGAGTGGAT

TGGACTTATTAGTCCTTACAATGGTGGTACTAGCTACAACCAGAAGTTCA

AGGGCAAGGCCACATTAACTGTAGACAAGTCATCCAGCACAGCCTACATG

GAGCTCCTCAGTCTGACATCTGAGGACTCTGCAGTCTATTACTGTGCAAG

AAGGGCCTACGGCTATGCTATGGACTACTGGGGTCAAGGAACCTCAGTCA

CCGTCTCCTCA (SEQ ID NO: 1182)

MGWSWIFLFLLSGTAGVHSEVQLQQSGPELVKPGASMKISCKASGFSFT<u>G</u>

<u>YTMN</u>WVKQSHVKNLEWIG<u>LISPYNGGTSYNQKFKG</u>KATLTVDKSSSTAYM

ELLSLTSEDSAVYYCAR<u>RAYGYAMDY</u>WGQGTSVTVSS (SEQ ID NO:

1183; Kabat CDRs are underlined; see also,

Table 19)

26A light chain variable region with signal
sequence
ATGGATTTTCAAGTGCAGATTTTCAGCTTCCTGCTAATCAGTGCCTCAGT

CATACTGTCCAGAGGACAAATTGTTCTCACCCAGTCTCCAGCAATCATGT

CTGCATCTCCAGGGGAGAAGGTCACCATGACCTGCAGTGCCAGCTCAAGT

GTAAGTTACATGTACTGGTACCAGCAGAAGCCAGGATCCTCCCCCAGACT

CCTGATTTATGACACATCCAACCTGGCTTCTGGAGTCCCTCTTCGCTTCA

GTGGCAGTGGGTCTGGGACCTCTTACTCTCTCACAATCAGCCGAATGGAG

GCTGAGGATGCTGCCACTTATTACTGCCAGCAGTGGAGTAGTTACCCATT

CACGTTCGGCTCGGGGACAAAGTTGGAAATAAAA (SEQ ID

NO: 1184)

MDFQVQIFSFLLISASVILSRGQIVLTQSPAIMSASPGEKVTMTC<u>SASSS</u>

<u>VSYMY</u>WYQQKPGSSPRLLIY<u>DTSNLAS</u>GVPLRFSGSGSGTSYSLTISRME

AEDAATYYCQQWSSYPFTFGSGTKLEIK (SEQ ID NO: 1185;

Kabat CDRs are underlined; see also, Table 19)

The nucleic acid and amino acid sequences for the heavy chain and light chain variable regions of the antibody 164A are shown below:

164A heavy chain variable region with signal sequence
ATGGGATGGACCTGGATCTTTATTTTAATCCTGTCAGTAACTACAGGTGT

CCACTCTGAGGTCCAGCTGCAGCAGTCTGGACCTGAGTTGGAGAAGCCTG

GCGCTTCAGTGAAGATATCCTGCAAGGCTTCTGGTTACTCATTCACTGGC

TACAACATGAACTGGGTGAAGCAGAGCAATGGAAAGAGCCTTGAGTGGAT

TGGAAATATTGATCCTTACTATGGTAGTGCTAGCTACAACCAGAAATTCA

AGGGCAAGGCCACATTGACTGTAGACAAATCCTCCACCACAGCCTACATG

CAGCTCAAGAGCCTGACATCTGAAGACTCTGCAGTCTATTACTGTACAAG

AAGTAATTATGGTTACTACGGGTACTTCGATGTCTGGGGCGCAGGGACCA

CGGTCACCGTCTCCTCA (SEQ ID NO: 1186)

MGWTWIFILILSVTTGVHSEVQLQQSGPELEKPGASVKISCKASGYSFTG

YNMNVWKQSNGKSLEWIGNIDPYYGSASYNQKFKGKATLTVDKSSTTAYM

QLKSLTSEDSAVYYCTRSNYGYYGYFDVWGAGTTVTSS (SEQ

ID NO: 1187; Kabat CDRs are underlined; see also, Table 20)

164A light chain variable region with signal sequence
ATGGAATCACAGACTCAGGTCTTCCTCTCCCTGCTGCTCTGGGTATCTGG

TACCTGTGGGAACATTATGATGACACAGTCGCCATCATCTCTGGCTGTGT

CTGCAGGAGAAAAGGTCACTATGAGCTGTAAGTCCAGTCAAAGTGTTTTA

TACAGTTCAAATCAGAAGAACTACTTGGCCTGGTACCAGCAGAAACCAGG

GCAGTCTCCTAAACTGCTGATCTATTGGGCATCCACTAGGGAATCTGGTG

TCCCTGATCGCTTCACAGGCAGTGGATCTGGGACAGATTTTACTCTTACT

ATCAGCAGTGTACAAGCTGAAGACCTGGCAGTTTATTACTGTCATCAATT

CCTCTCCTCGTACACGTTCGGAGGGGGGACCAAGCTGGAAATGAAA (SEQ ID NO: 1188)

MESQTQVFLSLLLWVSGTCGNIMMTQSPSSLAVSAGEKVTMSCKSSQSVL

YSSNQKNYLAWYQQKPGQSPKLLIYWASTRESGVPDRFTGSGSGTDFTLT

ISSVQAEDLAVYYCHQFLSSYTFGGGTKLEMK (SEQ ID NO: 1189;

Kabat CDRs are underlined; see also, Table 20)

164A light chain variable region number 2 with signal sequence
ATGGATTTTCAGGTGCAGATTTTCAGCTTCCTGTTAATCAGTGTCTCAGT

CATAATGTCCAGAGGAGAAAATGTGCTGACCCAGTCTCCAGCAATCATGG

CTGCATCTCCAGGGGAGAAGGTCACCATGACCTGCAGTGCCAGCTCAAGT

GTAAGTTCTAGTAACTTGCACTGGTACCAGCAGAAGTCAGGCACTTCTAC

CAAATTCTGGATTTATAGGACATCCAACCTGGCTTCAGAAGTCCCAGCTC

CCTTCAGTGGCAGTGGGTCTGGGACCTCTTACTCTCTTACAATCAGCAGC

GTGGAGGCCGAAGATGCTGCCACTTATTACTGCCAGCAGTGGAGTGGTTA

CCCACGGACGTTCGGTGGAGGCACCAAGCTGGAAAT

CAAA (SEQ ID NO: 1190)

MDFQVQIFSFLLISVSVIMSRGENVLTQSPAIMAASPGEKVTMTCSASSS

VSSSNLHWYQQKSGTSTKFWIYRTSNLASEVPAPFSGSGSGTSYSLTISS

VEAEDAATYYCQQWSGYPRTFGGGTKLEIK (SEQ ID NO: 1191;

Kabat CDRs are underlined; see also, Table 20)

The nucleic acid and amino acid sequences for the heavy chain and light chain variable regions of the antibody 230A are shown below:

230A heavy chain variable region with signal sequence
ATGGGATGGACCTGGATCTTTATTTTAATCCTGTCAGTAACTACAGGTGT

CCACTCTGAGGTCCAGCTGCAGCAGTCTGGACCTGAGCTGGAGAAGCCTG

GCGCTTCAGTGAAGATATCCTGCAAGGCTTCTGGTTACTCATTCACTGGC

TCCAACATGAACTGGGTGAAGCAGAACAATGGAAAGAGCCTTGAGTGGAT

TGGAAATATTGATCCTTACTATGGTTATACTACCTACAACCAGAAGTTCA

AGGGCAAGGCCACATTGACTGTAGACAAATCCTCCAGCACAGCCTACATG

CAGCTCAAGAGCCTGACATCTGAGGACTCTGCAGTCTATTACTGTGCAAG

AGACTATGATTACGCCCTCGGGTACTTCGATGTCTGGGGCGCAGGGACCA

CGGTCACCGTCTCCTCA (SEQ ID NO: 1916)

MGWTWIFILILSVTTGVHSEVQLQQSGPELEKPGASVKISCKASGYSFTG

SNMNWVKQNNGKSLEWIGNIDPYYGYTTYNQKFKGKATLTVDKSSSTAYM

QLKSLTSEDSAVYYCARDYDYALGYFDVWGAGTTVTSS (SEQ

ID NO: 1192; Kabat CDRs are underlined; see also, Table 21)

230A light chain variable region with signal sequence
ATGAAGTTGCCTGTTAGGCTGTTGGTGCTGATGTTCTGGATTCCTGCTTC

CAGCAGTGATGTTGTGATGACCCAAACTCCACTCTCCCTGCCTGTCAGTC

TTGGAGATCAAGCCTCCATCTCTTGCAGATCTAGTCAGAGCCTTGTACAC

AGTAATGGAAACACCTATTTACATTGGTACCTGCAGAAGCCAGGCCAGTC

TCCAAAGCTCCTGATCTACAAAGTTTCCAACCGATTTTCTGGGGTCCCAG

ACAGGTTCAGTGGCAGTGGATCAGGGACAGATTTCACACTCAAGATCAGC

AGAGTGGAGGCTGAGGATCTGGGAGTTTATTTCTGCTCTCAAAGTACACA

TGTTCCGTACACGTTCGGAGGGGGGACCAAGCTGGAAATA

AAA (SEQ ID NO: 1193)

MKLPVRLLVLMFWIPASSSDVMTQTPLSLPVSLGDQASISCRSSQSLVHS

NGNTYLHWYLQKPGQSPKLLIYKVSNRFSGVPDRFSGSGSGTDFTLKISR

VEAEDLGVYFCSQSTHVPYTFGGGTKLEIK (SEQ ID NO: 1194;

Kabat CDRs are underlined; see also, Table 21)

The nucleic acid and amino acid sequences for the heavy chain and light chain variable regions of the antibody 76E1 are shown below:

```
76E1 heavy chain variable region with signal
sequence
ATGGGATGGACCTGGATCTTTATTTTAATCCTGTCAGTAACTACAGGTGT
CCACTCTGAGGTCCAGCTGCTGCAGTCTGGACCTGAGCTGGAGAAGCCTG
GCGCTTCAGTGAAGATATCCTGCAAGGCTTCTGGTTACTCATTCACTGGC
TACAACATGAACTGGGTGAAGCAGAGCAATGGAAAGAGCCTTGAGTGGAT
TGGAAATATTGATCCTTACTATGATTATACTAGTTACAACCTGAAGTTCA
AGGACAAGGCCACATTGACTGTAGACAAATCCTCCAGCACAGCCTACATG
CAGCTCAAGAGCCTGACATCTGAGGACTCTGCAGTCTATTACTGTGCAAC
CTCTACTATGATTACTCCCTTTGACTACTGGGGCCAAGGCACCACTCTCA
CAGTCTCCTCA (SEQ ID NO: 1195)

MGWTWIFILILSVTTGVHSEVQLLQSGPELEKPGASVKISCKASGYSFTG
YNMNWVKQSNGKSLEWIGNIDPYYDYTSYNLKFKDKATLTVDKSSSTAYM
QLKSLTSEDSAVYYCATSTMITPFDYWGQGTTLTVSS (SEQ ID NO:
1196; Kabat CDRs are underlined; see
also, Table 22)

76E1 light chain variable region with signal
sequence
ATGAAGTTGCCTGTTAGGCTGTTGGTGCTGATGTTCTGGATTCCTGCTTC
CAGCAGTGATGTTTTGATGACCCAAACTCCACTCTCCCTGCCTGTCAGTC
TTGGAGATCAAGCCTCCATCTCTTGCAGATCTAGTCAGAGCATTGTACAT
AGTAATGGAAACACCTATTTAGAATGGTACCTGCAGAAACCAGGCCAGTC
TCCAAAGCTCCTGATCTACAAAGTTTCCAACCGATTTTCTGGGGTCCCAG
ACAGGTTCAGTGGCAGTGGATCAGGGACAGATTTCACACTCAAGATCAAC
AGAGTGGAGGCTGAAGATCTGGGAGTTTATTACTGCTTTCAAGGTTCACA
TGTTCCGTGGACGTTCGGTGGAGGCACCAAGCTGGAAATC
AAA (SEQ ID NO: 1197)

MKLPVRLLVLMFWIPASSSDVLMTQTPLSLPVSLGDQASISCRSSQSIVH
SNGNTYLEWYLQKPGQSPKLLIYKVSNRFSGVPDRFSGSGSGTDFTLKIN
RVEAEDLGVYYCFQGSHVPWTFGGGTKLEIK (SEQ ID NO: 1198;
Kabat CDRs are underlined; see also, Table 22)
```

The nucleic acid and amino acid sequences for the heavy chain and light chain variable regions of the antibody 53A are shown below:

```
53A heavy chain variable region with signal
sequence
ATGGAATGGAGTTGGATATTTCTCTTTCTCCTGTCAGGAACTGCAGGTGT
CCACTCTGAGGTCCAGCTGCAGCAGTCTGGACCTGAGCTGGTAAAGCCTG
GGGCTTCAGTGAAGATGTCCTGCAAGGCTTCTGGATACACATTCACTAGC
TATTTTATGCACTGGGTGAAGCAGAAGCCTGGGCAGGGCCTTGAGTGGAT
TGGATATATTTATCCTTACAATGATGGTACTAAGTACAATGAGAAGTTCA
AAGGCAAGGCCACACTGACTTCAGACAAATCCTCCAGCACAGCCTACATG
GAGCTCAGCAGCCTGACCTCTGAGGACTCTGCGGTCTATTACTGTGCAAG
ATTTGATTACGACACCCTGCGATACTGGGGCCAAGGCACCACTCTCACAG
TCTCCTCA (SEQ ID NO: 1199)

MEWSWIFLFLLSGTAGVHSEVQLQQSGPELVKPGASVKMSCKASGYTFTS
YFMHWKQKPGQGLEWIGYIYPYNDGTKYNEKFKGKATLTSDKSSSTAYME
LSSLTSEDSAVYYCARFDYDTLRYWGQGTTLTVSS (SEQ ID NO:
1200; Kabat CDRs are underlined; see
also, Table 23)

53A light chain variable region with signal
sequence
ATGAAGCTGCCTGTTCTGCTAGTGGTGCTGCTATTGTTCACGAGTCCAGC
CTCAAGTAGTGATGTTGTTCTGACCCAAACTCCACTCTCTCTGCCTGTCA
ATATTGGAGATCAAGCCTCTATCTCTTGCAAGTCTACTAAGAGTCTTCTG
AATAGTGATGGATTCACTTATTTGGACTGGTACCTGCAGAAGCCAGGCCA
GTCTCCACAGCTCCTAATATATTTGGTTTCTAATCGATTTTCTGGAGTTC
CAGACAGGTTCAGTGGCAGTGGGTCAGGAACAGATTTCACACTCAAGATC
AGCAGAGTGGAGGCTGAGGATTTGGGAGTTTATTATTGCTTCCAGAGTAA
CTATTTTCCGTGGACGTTCGGTGGAGGCACCAAGCTGGAAATC
AAA (SEQ ID NO: 1201)

MKLPVLLVVLLLFTSPASSSDVVLTQTPLSLPVNIGDQASISCKSTKSLL
NSDGFTYLDWYLQKPGQSPQLLIYLVSNRFSGVPDRFSGSGSGTDFTLKI
SRVEAEDLGVYYCFQSNYFPWTFGGGTKLEIK (SEQ ID NO: 1202;
Kabat CDRs are underlined; see also, Table 23)
```

The nucleic acid and amino acid sequences for the heavy chain and light chain variable regions of the antibody 259A are shown below:

```
259A heavy chain variable region with signal
sequence
ATGGAATGGAGTTGGATATTTCTCTTTCTCCTGTCAGGAACTGCAGGTGT
CCACTCTGAGGTCCAGCTGCAGCAGTCTGGACCTGAGCTGGTAAAGCCTG
GGGCTTCAGTGAAGATGTCCTGCAAGGCTTCTGGATACACATTCACTAGC
TATTTTATGCACTGGGTGAAGCAGAAGCCTGGGCAGGGCCTTGAGTGGAT
TGGATATATTTATCCTTACAATGATGGTACTAAGTACAATGAGAAGTTCA
AAGGCAAGGCCACACTGACTTCAGACAAATCCTCCAGCACAGCCTACATG
GACCTCAGCAGCCTGACCTCTGAAGACTCTGCGGTCTATTACTGTGCAAG
ATTTGATTACGACACCCTGCGATACTGGGGCCAAGGCACCACTCTCACA
GTCTCCTCA (SEQ ID NO: 1203)

MEWSWIFLFLLSGTAGVHSEVQLQQSGPELVKPGASVKMSCKASGYTFTS
YFMHWVKQKPGQGLEWIGYIYPYNDGTKYNEKFKGKATLTSDKSSSTAYM
DLSSLTSEDSAVYYCARFDYDTLRYWGQGTTLTVSS (SEQ ID NO:
1204; Kabat CDRs are underlined; see
also, Table 24)
```

259A light chain variable region with signal
sequence
ATGAAGCTGCCTGTTCTGCTAGTGGTGCTGCTATTGTTCACGAGTCCAGC

CTCAAGTAGTGATGTTGTTCTGACCCAAACTCCACTCTCTCTGCCTGTCA

ATATTGGAGATCAAGCCTCTATCTCTTGCAAGTCTACTAAGAGTCTTCTG

AATAGTGATGGATTCACTTATTTGGACTGGTACCTGCAGAAGCCAGGCCA

GTCTCCACAGCTCCTAATATATTTGATTTCTAATCGATTTTCTGGAGTTC

CAGACAGGTTCAGTGGCAGTGGGTCAGGAACAGATTTCACACTCAAGATC

AGCAGAGTGGAGGCTGAGGATTTGGGAGTTTATTATTGCTTCCAGAGTAA

CTATTTTCCGTGGACGTTCGGTGGAGGCACCAAGCTGGAAATC

AAA (SEQ ID NO: 1205)

MKLPVLLVVLLLFTSPASSSDVVLTQTPLSLPVNIGDQASISC<u>KSTKSLL
NSDGFTYLD</u>WYLQKPGQSPQLLIY<u>LISNRFS</u>GVPDRFSGSGSGTDFTLKI

SRVEAEDLGVYYC<u>FQSNYFPWT</u>FGGGTKLEIK (SEQ ID NO: 1206;

Kabat CDRs are underlined; see also, Table 24)

The nucleic acid and amino acid sequences for the heavy chain and light chain variable regions of the antibody 33A are shown below:

33A heavy chain variable region with signal
sequence
ATGGAATGGACCTGGGTCTTTCTCTTCCTCCTGTCAGTAACTGCAGGTGT

CCACTCCCAGGTTCAGCTGCAGCAGTCTGGAGCTGAGCTGATGAAGCCTG

GGGCCTCAGTGAAGATATCCTGCAAGGCTACTGGCTACACATTCAGTAGC

TACTGGATAGAGTGGGTAAAGCAGAGGCCTGGACATGGCCTTGAGTGGAT

TGGAGAGATTTTACCTGGAAGTGGTAGTACTAGCTACAATGAGAAGTTCA

AGGGCAAGGCCACATTCACTGCAGATACATCCTCCAACACAGCCTACATG

CAACTCAGCGGCCTGACATCTGAGGACTCTGCCGTCTATTACTGTGCAAG

ATGGTTACTATATTACTATGCTATGGTCTACTGGGGTCAAGGAACCTCAG

TCACCGTCTCCTCA (SEQ ID NO: 1207)

MEWTWVFLFLLSVTAGVHSQVQLQQSGAELMKPGASVKISCKATGYTFSS<u>
YWIE</u>WVKQRPGHGLEWIG<u>EILPGSGSTSYNEKFKG</u>KATFTADTSSNTAYM

QLSGLTSEDSAVYYCAR<u>WLLYYYAMVY</u>WGQGTSVTVSS (SEQ ID NO:

1208; Kabat CDRs are underlined; see also, Table 25)

33A light chain variable region with signal
sequence
ATGAAGTTGCCTGTTAGGCTGTTGGTGCTGATGTTCTGGATTCCTGCTTC

CAGCAGTGATGTTTTGATGACCCAAACTCCACTCTCCCTGCCTGTCAGTC

TTGGAGATCAAGCCTCCATCTCTTGCAGATCTAGTCAGAGCATTGTACAT

AGTAATGGAAACACCTATTTAGAATGGTACCTGCAGAAACCAGGCCAGTC

TCCAAAGCTCCTGATCTACAAAGTTTCCAACCGATTTTCTGGGGTCCCAG

ACAGGTTCAGTGGCAGTGGATCAGGGACAGATTTCACACTCAAGATCAGC

AGAGTGGAGGCTGAGGATCTGGGAGTTTATTACTGCTTTCAAGGTTCACA

TGTTCCGTACACGTTCGGAGGGGGGACCAAGCTGGAAATA

AAA (SEQ ID NO: 1209)

MKLPVRLLVLMFWIPASSSDVLMTQTPLSLPVSLGDQASISC<u>RSSQSIVH
SNGNTYLE</u>WYLQKPGQSPKLLIY<u>KVSNRFS</u>GVPDRFSGSGSGTDFTLKIS

RVEAEDLGVYYC<u>FQGSHVPYT</u>FGGGTKLEIK (SEQ ID NO: 1210;

Kabat CDRs are underlined; see also, Table 25)

The nucleic acid and amino acid sequences for the heavy chain and light chain variable regions of the antibody 39A are shown below:

39A heavy chain variable region with signal
sequence
ATGGAATGGACCTGGGTCTGTCTCTTCCTCCTGTCAGTAACTGCAGGTGT

CCACTCCCAGGTTCAGCTGCAGCAGTCTGGAGCTGAGCTGATGAAGCCTG

GGGCCTCAGTGAAGATATCCTGCAAGGCTACTGGCTACACATTCAGTAGT

AACTGGATAGAGTGGGTAAAGCAGAGGCCTGGACATGGCCTTGAGTGGAT

TGGAGAGATTTTACCTGGAAGTGGCAGTACTAGCTACAATGAGAAGTTCA

AGGGCAAGGCCACATTCACTGCAGATACATCCTCCAACACAGCCTACATG

CAGCTCAGCAGCCTGACATCTGAAGACTCTGCCGTCTATTACTGTGCAAG

ATGGTTACTATATTACTATGCTATGGACTACTGGGGTCAAGGAACCTCAG

TCACCGTCTCCTCA (SEQ ID NO: 1211)

MEWTWVCLFLLSVTAGVHSQVQLQQSGAELMKPGASVKISCKATGYTFSS<u>
NWIE</u>WVKQRPGHGLEWIG<u>EILPGSGSTSYNEKFKG</u>KATFTADTSSNTAYM

QLSSLTSEDSAVYYCAR<u>WLLYYYAMDY</u>WGQGTSVTVSS (SEQ ID NO:

1212; Kabat CDRs are underlined; see also, Table 26)

39A light chain variable region with signal
sequence
ATGAAGTTGCCTGTTAGGCTGTTGGTGCTGATGTTCTGGATTCCTGCTTC

CAGCAGTGATGTTTTGATGACCCAAACTCCACTCTCCCTGCCTGTCAGTC

TTGGAGATCCAGCCTCCATCTCTTGCAGATCTAGTCAGAGCATTGTACAT

AATAATGGAAACACCTATTTAGAATGGTACCTGCAGAAACCAGGCCAGTC

TCCAAAGCTCCTGATCTACAAAGTTTCCAACCGATTTTCTGGGGTCCCAG

ACAGGTTCAGTGGCAGTGGATCAGGGACAGATTTCACACTCAAGATCAGC

AGAGTGGAGGCTGAGGATCTGGGAGTTTATTACTGCTTTCAAGGTTCACA

TGTTCCGTACACGTTCGGAGGGGGGACCAAGCTGGAAAT

AAAA (SEQ ID NO: 1213)

MKLPVRLLVLMFWIPASSSDVLMTQTPLSLPVSLGDPASISC<u>RSSQSIVH
NNGNTYLE</u>WYLQKPGQSPKLLIY<u>KVSNRFS</u>GVPDRFSGSGSGTDFTLKIS

RVEAEDLGVYYC<u>FQGSHVPYT</u>FGGGTKLEIK (SEQ ID NO: 1214;

Kabat CDRs are underlined; see also, Table 26)

The nucleic acid and amino acid sequences for the heavy chain and light chain variable regions of the antibody 124A are shown below:

124A heavy chain variable region with signal sequence
ATGGAATGGACCTGGGTCTTTCTCTTCCTCCTGTCAGTAACTGCAGGTGT

CCACTCCCAGGTTCAGCTGCAGCAGTCTGGAGCTGAGCTGATGAAGCCTG

GGGCCTCAGTGAAGATATCCTGCAAGGCTACTGGCTACACATTCAGTAGC

AACTGGATAGAGTGGGTAAAGCAGAGGCCTGGACATGGCCTTGAGTGGAT

GGGAGAGATTTTACCTGGAAGTGGCAGTACTAGCTACAATGAGAAGTTCA

AGGGCAAGGCCACATTCACTGCAGATACATCCTCCAACACAGCCTACATG

CAGCTCAGCAGCCTGACATCTGAAGACTCTGCCGTCTATTACTGTGCAAG

ATGGTTACTATATTACTATGCTATGGACTTCTGGGGTCAAGGAACCTCAG

TCACCGTCTCCTCA (SEQ ID NO: 1215)

MEWTWVFLFLLSVTAGVHSQVQLQQSGAELMKPGASVKISCKATGYTFS<u>S</u>

<u>NW</u>IEWVKQRPGHGLEWMG<u>EILPGSGSTSYNEKFK</u>GKATFTADTSSNTAYM

QLSSLTSEDSAVYYCAR<u>WLLYYYAMDF</u>WGQGTSVTVSS (SEQ ID NO:

1216; Kabat CDRs are underlined; see also, Table 27)

124A light chain variable region with signal sequence
ATGAAGTTGCCTGTTAGGCTGTTGGTGCTGATGTTCTGGATTCCTGCTTC

CAGCAGTGATGTTTTGATGACCCAAACTCCACTCTCCCTGCCTGTCAGTC

TTGGAGATCAAGCCTCCATCTCTTGCAGATCTAGTCAGAGCATTGTACAT

AATAATGGAAACACCTATTTAGAATGGTACCTGCAGAAACCAGGCCAGTC

TCCAAAGCTCCTGATCTACAAAGTTTCCAACCGATTTTCTGGGGTCCCAG

ACAGGTTCAGTGGCAGTGGATCAGGGACAGATTTCACACTCAAGATCAGC

AGAGTGGAGGCTGAGGATCTGGGAGTTTATTACTGCTTTCAAGGTTCACA

TGTTCCGTACACGTTCGGAGGGGGGACCAAGCTGGAAATA

AAA (SEQ ID NO: 1217)

MKLPVRLLVLMFWIPASSSDVLMTQTPLSLPVSLGDQASISC<u>RSSQSIVH</u>

<u>NNGNTYLE</u>WYLQKPGQSPKLLIY<u>KVSNRFS</u>GVPDRFSGSGSGTDFTLKIS

RVEAEDLGVYYC<u>FQGSHVPYT</u>FGGGTKLEIK (SEQ ID NO: 1218;

Kabat CDRs are underlined; see also, Table 27)

The nucleic acid and amino acid sequences for the heavy chain and light chain variable regions of the antibody 175A are shown below:

175A heavy chain variable region with signal sequence
ATGGAATGGACCTGGGTCTTTCTCTTCCTCCTGTCAGTAACTGCAGGTGT

CCACTCCCAGGTTCAGCTGCAGCAGTCTGGAGCTGAGCTGATGAAGCCTG

GGGCCTCAGTGAAGATATCCTGCAAGGCTACTGGCTACACATTCAGTACC

CACTGGATAGAGTGGGTAAAGCAGAGGCCTGGACATGGCCTTGAGTGGAT

TGGAGAGATTTTACCTGGAAGTGGTAGTACTAGCTACAATGAGAAGTTCA

AGGGCAAGGCCACATTCACTGCAGATACATCCTCCAACACAGCCTACATG

CAACTCAGCAGCCTGACATCTGAGGACTCTGCCGTCTATTACTGTGCAAG

ATGGTTACTATATTACTATGCTATGGACTACTGGGGTCAAGGAACCTCAG

TCACCGTCTCCTCA (SEQ ID NO: 1219)

MEWTWVFLFLLSVTAGVHSQVQLQQSGAELMKPGASVKISCKATG<u>YTFST</u>

<u>HWIE</u>WVKQRPGHGLEWIG<u>EILPGSGSTSYNEKFK</u>GKATFTADTSSNTAYM

QLSSLTSEDSAVYYCAR<u>WLLYYYAMDY</u>WGQGTSVTVSS (SEQ ID NO:

1220; Kabat CDRs are underlined; see also, Table 28)

175A light chain variable region with signal sequence
ATGAAGTTGCCTGTTAGGCTGTTGGTGCTGATGTTCTGGATTCCTGCTTC

CAGCAGTGATGTTTTGATGACCCAAACTCCACTCTCCCTGCCTGTCAGTC

TTGGAGATCAAGCCTCCATCTCTTGCAGATCTAGTCAGAGCATTGTACAT

AGTAATGGAAACACCTATTTAGAATGGTACCTGCAGAAACCAGGCCAGTC

TCCAAAGCTCCTGATCTACAAACTTTCCAACCGATTTTCTGGGGTCCCAG

ACAGGTTCAGTGGCAGTGGATCAGGGACAGATTTCACACTCAAGATCAGC

AGAGTGGAGGCTGAGGATCTGGGAGTTTATTACTGCTTTCAAGGTTCACA

TTTTCCGTACACGTTCGGAGGGGGGACCAAGCTGGAAA

TAAAA (SEQ ID NO: 1221)

MKLPVRLLVLMFWIPASSSDVLMTQTPLSLPVSLGDQASISC<u>RSSQSIVH</u>

<u>SNGNTYLE</u>WYLQKPGQSPKLLIY<u>KLSNRFS</u>GVPDRFSGSGSGTDFTLKIS

RVEAEDLGVYYC<u>FQGSHFPYT</u>FGGGTKLEIK (SEQ ID NO: 1222;

Kabat CDRs are underlined; see also, Table 28)

The nucleic acid and amino acid sequences for the heavy chain and light chain variable regions of the antibody 321D are shown below:

321D heavy chain variable region with signal sequence
ATGGAATGGACCTGGGTCTTTCTCTTCCTCCTGTCAGTAACTGCAGGTGT

CCACTCCCAGGTTCAGCTGCAGCAGTCTGGAGCTGAGCTGATGAAGCCTG

GGGCCGCAGTGAAGATATCCTGCAAGGCTACTGGCTACACATTCAGTAGC

CACTGGATAGAGTGGGTAAAGCAGAGGCCTGGACATGGCCTTGAGTGGAT

TGGAGAGATTTTACCTGGAAGTGGTAGTACTGACTACAATGAGAAGTTCA

AGGGCAAGGCCACATTCACTGCAGATACATCCTCCAACACAGCCTACATG

CAACTCAGCAGCCTGACATCTGAGGACTCTGCCGTCTATTACTGTGCAAG

ATGGTTACTATATTACTATGCTATGGACTACTGGGGTCAAGGAACCTCAG

TCACCGTCTCCTCA (SEQ ID NO: 1223)

MEWTWVFLFLLSVTAGVHSQVQLQQSGAELMKPGAAVKISCKATGYTFS<u>S</u>

<u>HW</u>IEWVKQRPGHGLEWIG<u>EILPGSGSTDYNEKFK</u>GKATFTADTSSNTAYM

QLSSLTSEDSAVYYCAR<u>WLLYYYAMDY</u>WGQGTSVTVSS (SEQ ID NO:

1224; Kabat CDRs are underlined; see also, Table

29)

321D light chain variable region with signal sequence
ATGAAGTTGCCTGTTAGGCTGTTGGTGCTGATGTTCTGGATTCCTGCTTC -continued
```
CAGCAGTGATGTTTTGATGACCCAAACTCCACTCTCCCTGCCTGTCAGTC

TTGGAGATCAAGCCTCCATCTCTTGCAGATCTAGTCAGAGCATTGTACAT

AGTAATGGAAACACCTATTTAGAATGGTACCTGCAGAAACCAGGCCAGTC

TCCAAAGCTCCTGATCTACAAAGTTTCCAACCGATTTTCTGGGGTCCCAG

ACAGGTTCAGTGGCAGTGGATCAGGGACAGATTTCACACTCAAGATCACC

AGAGTGGAGGCTGAGGATCTGGGAGTTTATTACTGCTTTCAAGGTTCACA

TGTTCCGTTCACGTTCGGAGGGGGGACCAAGCTGGAAATAAAA (SEQ

ID NO: 1225)

MKLPVRLLVLMFWIPASSSDVLMTQTPLSLPVSLGDQASISCRSSQSIVH

SNGNTYLEWYLQKPGQSPKLLIYKVSNRFSGVPDRFSGSGSGTDFTLKIT

RVEAEDLGVYYCFQGSHVPFTFGGGTKLEIK (SEQ ID NO: 1226;

Kabat CDRs are underlined; see also, Table 29)
```

The nucleic acid and amino acid sequences for the heavy chain and light chain variable regions of the antibody 141A are shown below:

```
141A heavy chain variable region with signal
sequence
ATGGAATGGACCTGGGTCTTTCTCTTCCTCCTGTCAGTAACTGCAGGTGT

CCACTCCCAGGTTCAGCTGCAGCAGTCTGGAGCTGAGCTGATGAAGCCTG

GGGCCTCAGTGAAGATATCCTGCAAGGCTACTGGCTACACATTCAGTAGG

TACTGGATAGAGTGGGTAAAGCAGAGGCCTGGACATGGCCTTGAGTGGAT

TGGAGAGATTTTACCTGGAAGTGGTAGTACTAACTACAATGAGAAGTTCA

AGGGCAAGGCCACATTCACTGCAGATACATCCTCCAACACAGCCTACATG

CAACTCAGCAGCCTGACATCTGAGGACTCTGCCGTCTATTACTGTGCAGG

AGAGGAAGTCTATGATGGTTACCCCTGGTTTGGTTACTGGGGCCAAGGGA

CTCTGGTCACTGTCTCTGCA (SEQ ID NO: 1227)

MEWTWVFLFLLSVTAGVHSQVQLQQSGAELMKPGASVKISCKATGYTFSR

YWIEWVKQRPGHGLEWIGEILPGSGSTNYNEKFKGKATFTADTSSNTAYM

QLSSLTSEDSAVYYCAGEEVYDGYPWFGYWGQGTLVTVSA (SEQ ID

NO: 1228; Kabat CDRs are underlined; see also,

Table 30)

141A light chain variable region with signal
sequence
ATGGATTTTCAAGTGCAGATTTTCAGCTTCCTGCTAATCAGTGCTTCAGT

CATAATGTCCAGAGGACAAATTGTTCTCTCCCAGTCTCCAGCAATCCTGT

CTGCATCTCCAGGGGAGAAGGTCACAATGACTTGCAGGGCCAGCTCAAGT

TTAAGTTACATGCACTGGTACCAGCAGAAGCCAGGATCCTCCCCCAAACC

CTGGATTTATGCCACATCCAACCTGGCTTCTGGAGTCCCTGCTCGCTTCA

GTGGCAGTGGGTCTGGGACCTCTTACTCTCTCACAATCAGCAGAGTGGAG

GCTGAAGATGCTGCCACTTATTACTGCCAGCAGTGGAGTAGTAACCCGTA

CACGTTCGGAGGGGGGACCAAGCTGGAAATAAAA (SEQ ID NO:

1229)

MDFQVQIFSFLLISASVIMSRGQIVLSQSPAILSASPGEKVTMTCRASSS
```

```
LSYMHWYQQKPGSSPKPWIYATSNLASGVPARFSGSGSGTSYSLTISRVE

AEDAATYYCQQWSSNPYTFGGGTKLEIK (SEQ ID NO: 1230;

Kabat CDRs are underlined; see also, Table 30)
```

The nucleic acid and amino acid sequences for the heavy chain and light chain variable regions of the antibody 51A are shown below:

```
51A heavy chain variable region with signal
sequence
ATGGAATGGACCTGGGTCTTTCTCTTCCTCCTGTCAGTAACTGCAGGTGT

CCACTCCCAGGTTCAGCTGCAGCAGTCTGGAGCTGAGCTGATGAAGCCTG

GGGCCTCAGTGAAGATATCCTGCAAGGCTACTGGCTACACATTCAGTAGG

TACTGGATAGAGTGGGTAAAGCAGAGGCCTGGACATGGCCTTGAGTGGAT

TGGAGAGATTTTACCTGGAAGTGGTAGTACTAACTACAATGAGAAGTTCA

AGGGCAAGGCCACATTCACTGCAGATACATCCTCCAACACAGCCTACATG

CAACTCAGCAGCCTGACATCTGAGGACTCTGCCGTCTATTACTGTGCAAG

CGAGGAAGTCTATGATGGTTACCCCTGGTTTGGTTACTGGGGCCAAGGGA

CTCTGGTCACTGTCTCTGCA (SEQ ID NO: 1231)

MEWTWVFLFLLSVTAGVHSQVQLQQSGAELMKPGASVKISCKATGYTFSR

YWIEWVKQRPGHGLEWIGEILPGSGSTNYNEKFKGKATFTADTSSNTAYM

QLSSLTSEDSAVYYCASEEVYDGYPWFGYWGQGTLVTVSA (SEQ ID

NO: 1232; Kabat CDRs are underlined; see also,

Table 31)

51A light chain variable region with signal
sequence
ATGGATTTTCAAGTGCAGATTTTCAGCTTCCTGCTAATCAGTGCTTCAGT

CATAATGTCCAGAGGACAAATTGTTCTCTCCCAGTCTCCAGCAATCCTGT

CTGCATCTCCAGGGGAGAAGGTCACAATGACTTGCAGGGCCAGCTCAAGT

TTAAGTTACATGCACTGGTACCAGCAGAAGCCAGGATCCTCCCCCAAACC

CTGGATTTATGCCACATCCAACCTGGCTTCTGGAGTCCCTGCTCGCTTCA

GTGGCAGTGGGTCTGGGACCTCTTACTCTCTCACAATCAGCAGAGTGGAG

GCTGAAGATGCTGCCACTTATTACTGCCAGCAGTGGAGTAGTAACCCGTA

CACGTTCGGAGGGGGGACCAAGCTGGAAATAAAA (SEQ ID NO:

1233)

MDFQVQIFSFLLISASVIMSRGQIVLSQSPAILSASPGEKVTMTCRASSS

LSYMHWYQQRPGSSPKPWIYATSNLASGVPARFSGSGSGTSYSLTISRVE

AEDAATYYCQQWSSNPYTFGGGTKLEIK (SEQ ID NO: 1234;

Kabat CDRs are underlined; see also, Table 31)
```

The nucleic acid and amino acid sequences for the heavy chain and light chain variable regions of the antibody 353A are shown below:

```
353A heavy chain variable region with signal
sequence
ATGGATTTTGGGCTGATTTTTTTTATTGTTGCTCTTTTAAAAGGGGTCCA
```

```
GTGTGAGGTGAAGCTTCTCGAGTCTGGAGGTGGCCTGGTGCAGCCTGGAG

GATCCCTGAAACTCTCCTGTGCAGCCTCAGGATTCGATTTTAGTAGATAC

TGGATGAATTGGGTCCGGCAGGCTCCAGGGAAAGGGCTAGAATGGATTGG

AGAAATTAATCCAGATAGCAGTACGATAAACTATACGCCATCTCTAAAGG

ATAAATTCATCATCTCCAGAGACAACGCCAAAAATACGCTGTACCTGCAA

ATGAGCAAAGTGAGATATGAGGACACAGCCCTTTATTACTGTGCAAGACC

GGGGGAAATTTATTACTACGGTAGTTACTGGTTTGCTTACTGGGGCCAAG

GGACTCTGGTCACTGTCTCTGCA (SEQ ID NO: 1235)

MDFGLIFFIVALLKGVQCEVKLLESGGGLVQPGSSLKLSCAASGFDFSRY
WMNWVRQAPGKGLEWIGEINPDSSTINYTPSLKDKFIISRDNAKNTLYLQ
MSKVRYEDTALYYCARPGEIYYYGSYWFAYWGQGTLVTVSA (SEQ ID

NO: 1236; Kabat CDRs are underlined; see also,

Table 32)

353A light chain variable region with signal
sequence
ATGGAGTCAGACACACTCCTGCTATGGGTGCTGCTGCTCTGGGTTCCAGG

CTCCACTGGTGACATTGTGCTCACCCAATCTCCAGCTTCTTTGGCTGTGT

CTCTAGGGCAGAGAGCCACCATCTCCTGCAGAGCCAGTGAAAGTGTTGAA

TATTATGGCACAAGTTTAATGCAGTGGTTCCAACAGAAACCAGGACAGCC

ACCCAAACTCCTCATCTATGCTGCATCCAACGTAGAATCTAGGGTCCCTG

CCAGGTTTAGTGGCAGTGGGTCTGGGACAGACTTCAGCCTCAACATCCAT

CCTGTGGAGGAGGATGATATTGCAATGTATTTCTGTCAGCAAAGTAGGAA

GGATCCTTGGACATTCGGTGGAGGCACCAAGCTGGAAATCAAA (SEQ ID

NO: 1237)

MESDTLLLWVLLLWVPGSTGDIVLTQSPASLAVSLGQRATISCRASESVE
YYGTSLMQWFQQKPGQPPKLLIYAASNVESRVPARFSGSGSGTDFSLNIH
PVEEDDIAMYFCQQSRKDPWTFGGGTKLEIK (SEQ ID NO: 1238;

Kabat CDRs are underlined; see also, Table 32)
```

The nucleic acid and amino acid sequences for the heavy chain and light chain variable regions of the antibody 305A are shown below:

```
305A heavy chain variable region with signal
sequence
ATGAAAGTGTTGAGTCTGTTGTACCTGTTGACAGCCATTCCTGGTATCCT

GTCTGATGTACAGCTTCAGGAGTCAGGACCTGGCCTCGTGAAACCTTCTC

AGTCTCTGTCTCTCACCTGCTCTGTCACTGGCTACTCCATCACCAGTGGT

TATTACTGGAACTGGATCCGGCAGTTTCCAGGAAACAAACTGGAATGGAT

GGGCTACATAAGCTACGACGGTAGCAATAACTACAACCCATCTCTCAAA

ATCGAATCTCCATCACTCGTGACACATCTAAGAACCAGTTTTTCCTGAAG

TTGAATTCTGTGACTACTGAGGACACAGCTACATATTACTGTGCAAGACG

GCATGATTACCTCTCCTTTGCTTACTGGGGCCAAGGGACTCTGGTCATTG

TCTCTGCA (SEQ ID NO: 1239)

MKVLSLLYLLTAIPGILSDVQLQESGPGLVKPSQSLSLTCSVTGYSITSG
YYWNWIRQFPGNKLEWMGYISYDGSNNYNPSLKNRISITRDTSKNQFFLK
LNSVTTEDTATYYCARRHDYLSFAYWGQGTLVIVSA (SEQ ID NO:

1240; Kabat CDRs are underlined; see also, Table

33)

305A light chain variable region with signal
sequence
ATGGAGACAGACACAATCCTGCTATGGGTGCTGCTGCTCTGGGTTCCAGG

CTCCACTGGTGACATTGTGCTGACCCAATCTCCAGCTTCTTTGGCTGTGT

CTCTAGGGCAGAGGGCCACCATCTCCTGCAAGGCCAGCCAAAGTGTTGAT

TATGATGGTGATAGTTATATGAACTGGTACCAACAGAAACCAGGACAGCC

ACCCAAACTCCTCATCTATGCTGCATCCAATCTAGAATCTGGGATCCCAG

CCAGGTTTAGTGGCAGTGGGTCTGGGACAGACTTCACCCTCAACATCCAT

CCTGTGGAGGAGGAGGATGCTGCAACCTATTACTGTCAGCAAAGTGATGA

GGATCCGTACACGTTCGGAGGGGGGACCAAGCTGGAAATAAAA (SEQ ID

NO: 1241)

METDTILLWVLLLWVPGSTGDIVLTQSPASLAVSLGQRATISCKASQSVD
YDGDSYMNWYQQKPGQPPKLLIYAASNLESGIPARFSGSGSGTDFTLNIH
PVEEEDAATYYCQQSDEDPYTFGGGTKLEIK (SEQ ID NO: 1242;

Kabat CDRs are underlined; see also, Table 33)
```

CDR sequences for the selected twenty-two monoclonal antibodies are provided in Tables 12-33 and are used for the preparation of humanized anti-C10orf54 antibodies.

Example 4—Binning and Epitope Mapping of Anti-c10orf54 Antibodies

Paratope diversity of the 22 anti-human C10orf54 antibodies the VH's and VK's was evaluated by analyzing the variable region sequences. An IMGT/V-Quest search (IMGT®, the international ImMunoGeneTics information System® http://www.imgt.org (founder and director: Marie-Paule Lefranc, Montpellier, France)) of each nucleotide sequence was conducted, and the germline gene sequence with the highest degree of identity with the query sequence was tabulated (Table 37). Antibodies with the same VH and VK germline gene sequences were placed in the same paratope group (Table 37).

TABLE 37

| Ab | Antibody Designation | VH | VK | Paratope Binning |
|---|---|---|---|---|
| 1 | 5B | IGHV1S137*01 | IGKV6-32*01 | 1 |
| 2 | 46A | IGHV1S137*01 | IGKV6-32*01 | 1 |
| 3 | 97A | IGHV1S137*01 | IGKV6-32*01 | 1 |
| 4 | 128A | IGHV1S137*01 | IGKV6-32*01 | 1 |
| 5 | 146C | IGHV1S137*01 | IGKV6-32*01 | 1 |
| 6 | 208A | IGHV1S137*01 | IGKV6-32*01 | 1 |
| 7 | 215A | IGHV1-26*01 | IGKV4-55*01 | 2 |
| 8 | 26A | IGHV1-18*01 | IGKV4-55*01 | 3 |
| 9 | 164A | IGHV1-39*01 | IGKV8-27*01/ IGKV4-81*01 | 4 |
| 10 | 230A | IGHV1-39*01 | IGKV1-110*01 | 5 |
| 11 | 76E1 | IGHV1-39*01 | IGKV1-117*01 | 6 |
| 12 | 53A | IGHV1-14*01 | IGKV1-99*01 | 7 |
| 13 | 259A | IGHV1-14*01 | IGKV1-99*01 | 7 |
| 14 | 33A | IGHV1-9*01 | IGKV1-117*01 | 8 |

TABLE 37-continued

| Ab | Antibody Designation | VH | VK | Paratope Binning |
|---|---|---|---|---|
| 15 | 39A | IGHV1-9*01 | IGKV1-117*01 | 8 |
| 16 | 124A | IGHV1-9*01 | IGKV1-117*01 | 8 |
| 17 | 175A | IGHV1-9*01 | IGKV1-117*01 | 8 |
| 18 | 321D | IGHV1-9*01 | IGKV1-117*01 | 8 |
| 19 | 141A | IGHV1-9*01 | IGKV4-72*01 | 9 |
| 20 | 51A | IGHV1-9*01 | IGKV4-72*01 | 9 |
| 21 | 353A | IGHV4-1*02 | IGKV3-1*01 | 10 |
| 22 | 305A | IGHV3-6*02 | IGKV3-4*01 | 11 |

To investigate epitope diversity of the anti-human C10orf54 antibodies, 293t cells were transfected with 1 of 10 different C10orf54 expression constructs that co-express a fluorescent marker. The C10orf54 proteins and chimeric proteins encoded by the constructs used is shown in Table 38. Two days after transfection, cells were stripped from the tissue culture plate, stained with 2 µg/ml anti-human C10orf54 antibody, washed, stained with anti-mouse IgG-Fc Alexa Fluor 647 polyclonal antibody, washed, and stained with the viability dye 4',6-Diamidino-2-Phenylindole, Dihydrochloride. Upon acquisition of 10,000 live events on a flow cytometer, live cells marked with the fluorescent marker were analyzed for the degree of staining by the anti-human C10orf54 antibody. When the median fluorescence intensity fold-change relative to an isotype control antibody was at least 20-fold, the antibody was considered to stain the C10orf54 expression construct in question. The results of these binning experiments and the description of the construct bins are shown in Table 39.

TABLE 38

| Construct Designation | C10orf54 Proteins and Chimeric Proteins Encoded by the Construct Description |
|---|---|
| CC1 | full length human |
| CC2 | full length mouse |
| CC3 | full length rat |
| CC4 | full length cynomolgus monkey (cyno) |
| CC5 | human IgV with mouse STALK* |
| CC6 | mouse IgV with human STALK* |
| CC7 | first half of IgV human and remainder (including loop) mouse* |
| CC8 | first half of IgV mouse and remainder (including loop) human* |
| CC9 | human with mouse loop* |
| CC10 | mouse with human loop* |

*Human IgV domain = aa33-169; Mouse IgV domain = aa33-168; Human loop = aa84-116; Mouse loop = aa84-116; Human Stalk = aa170-194; Mouse Stalk = aa169-192; Human Extracellular Domain (hECD) = aa33-194; Mouse Extracellular Domain (mECD) 33-192

The amino acid sequences for the C10orf54 proteins and chimeric proteins encoded by the expression constructs are shown below.

The amino acid sequence for the human C10orf54 protein encoded by the CC1 expression construct is shown below:

MGVPTALEAGSWRWGSLLFALFLAASLGPVAAFKVATPYSLYVCPEGQNV

TLTCRLLGPVDKGHDVTFYKTWYRSSRGEVQTCSERRPIRNLTFQDLHLH

HGGHQAANTSHDLAQRHGLESASDHHGNFSITMRNLTLLDSGLYCCLVVE

IRHHHSEHRVHGAMELQVTGKDAPSNCVVYPSSSQDSENITAAALATGA

CIVGILCLPLILLLVYKQRQAASNRRAQELVRMDSNIQGIENPGFEASPP

AQGIPEAKVRHPLSYVAQRQPSESGRHLLSEPSTPLSPPGPGDVFFPSLD

PVPDSPNFEVI (SEQ ID NO: 1079; C10orf54 Construct 1 (CC1))

The amino acid sequence for the mouse C10orf54 protein encoded by the CC2 expression construct is shown below:

MGVPAVPEASSPRWGTLLLAIFLAASRGLVAAFKVTTPYSLYVCPEGQNA

TLTCRILGPVSKGHDVTIYKTWYLSSRGEVQMCKEHRPIRNFTLQHLQHH

GSHLKANASHDQPQKHGLELASDHHGNFSITLRNVTPRDSGLYCCLVIEL

KNHHPEQRFYGSMELQVQAGKGSGSTCMASNEQDSDSITAAALATGACIV

GILCLPLILLLVYKQRQVASHRRAQELVRMDSSNTQGIENPGFETTPPFQ

GMPEAKTRPPLSYVAQRQPSESGRYLLSDPSTPLSPPGPGDVFFPSLDPV

PDSPNSEAI (SEQ ID NO: 1243; C10orf54 Construct 2 (CC2))

The amino acid sequence for the rat C10orf54 protein encoded by the CC3 expression construct is shown below:

MGVPTVPEASSLRWGTLLLTIFLAASRGLVAAIKVTTPYSLYVCPEGQNV

TLTCRILDSVSKGHDANFLKTWFLSSRGEVQVCKEHRPIRNFISHHQHHR

SHPAVNASHDQPQKHGLEIAYDNHGNFSITLHNVTLSDSGLYCCLVIEVK

HHHPERRLYGYMELQVQTGKGSASTCTAYPPNEQDSDSITAAALATGACI

VGILCLPLILLLVYKQRQAASHRRAQELVRMDSNTQGIENPGYETTPPFQ

GMPEAKTRPPLSYVAQRQPSESGRHLLSDPSTPLSPPGPGDVFFPSLDPV

PDSPNSEAI (SEQ ID NO: 1244; C10orf54 Construct 3 (CC3))

The amino acid sequence for the cynomolgus C10orf54 protein encoded by the CC4 expression construct is shown below:

MGVPTAPEAGCWRWGSLLFALFLAASLGPVAAFKVATLYSLYVCPEGQNV

TLTCRVFGPVDKGHDVTFYKTWYRSSRGEVQTCSERRPIRNLTFQDLHLH

HGGHQAANTSHDLAQRHGLESASDHHGNFSITMRNLTLLDSGLYCCLVVE

IRHHHSEHRVHGAMELQVTGKDAPSSCVAYPSSSQESENITAAALATGA

CIVGILCLPLILLLVYKQRQAASNRRAQELVRMDSNTQGIENPGFEASSP

AQGILEAKVRHPLSYVAQRQPSESGRHLLSEPGTPLSPPGPGDVFFPSLD

PVPDSPNFEVI (SEQ ID NO: 1245; C10orf54 Construct 4 (CC4))

The amino acid sequence for chimeric protein encoded by the CC5 expression construct is shown below

MGVPTALEAGSWRWGSLLFALFLAASLGPVAAFKVATPYSLYVCPEGQNV

TLTCRLLGPVDKGHDVTFYKTWYRSSRGEVQTCSERRPIRNLTFQDLHLH

HGGHQAANTSHDLAQRHGLESASDHHGNFSITMRNLTLLDSGLYCCLVVE

IRHHHSEHRVHGAMELQVQAGKGSGSTCMASNEQDSDSITAAALATGACI

VGILCLPLILLLVYKQRQVASHRRAQELVRMDSSNTQGIENPGFETTPPF

QGMPEAKTRPPLSYVAQRQPSESGRYLLSDPSTPLSPPGPGDVFFPSLDP

VPDSPNSEAI (SEQ ID NO: 1246; C10orf54 Construct 5

(CC5) with human sequence underlined)

The amino acid sequence for chimeric protein encoded by the CC6 expression construct is shown below

MGVPAVPEASSPRWGTLLLAIFLAASRGLVAAFKVTTPYSLYVCPEGQNA

TLTCRILGPVSKGHDVTIYKTWYLSSRGEVQMCKEHRPIRNFTLQHLQHH

GSHLKANASHDQPQKHGLELASDHHGNFSITLRNVTPRDSGLYCCLVIEL

KNHHPEQRFYGSMELQVQTGKDAPSNCVVYPSSSQDSENITAAALATGAC

IVGILCLPLILLLVYKQRQAASNRRAQELVRMDSNIQGIENPGFEASPPA

QGIPEAKVRHPLSYVAQRQPSESGRHLLSEPSTPLSPPGPGDVFFPSLDP

VPDSPNFEVI (SEQ ID NO: 1247; C10orf54 Construct 6

(CC6) with human sequence underlined)

The amino acid sequence for chimeric protein encoded by the CC7 expression construct is shown below

MGVPTALEAGSWRWGSLLFALFLAASLGPVAAFKVATPYSLYVCPEGQNV

TLTCRLLGPVDKGHDVTFYKTWYRSSRGEVQTCKEHRPIRNFTLQHLQHH

GSHLKANASHDQPQKHGLELASDHHGNFSITLRNVTPRDSGLYCCLVIEL

KNHHPEQRFYGSMELQVQAGKGSGSTCMASNEQDSDSITAAALATGACIV

GILCLPLILLLVYKQRQVASHRRAQELVRMDSSNTQGIENPGFETTPPFQ

GMPEAKTRPPLSYVAQRQPSESGRYLLSDPSTPLSPPGPGDVFFPSLDPV

PDSPNSEAI (SEQ ID NO: 1248; C10orf54 Construct 7

(CC7) with human sequence underlined)

The amino acid sequence for chimeric protein encoded by the CC8 expression construct is shown below

MGVPAVPEASSPRWGTLLLAIFLAASRGLVAAFKVTTPYSLYVCPEGQNA

TLTCRILGPVSKGHDVTIYKTWYLSSRGEVQMCSERRPIRNLTFQDLHLH

HGGHQAANTSHDLAQRHGLESASDHHGNFSITMRNLTLLDSGLYCCLVVE

IRHHHSEHRVHGAMELQVQTGKDAPSNCVVYPSSSQDSENITAAALATGA

CIVGILCLPLILLLVYKQRQAASNRRAQELVRMDSNIQGIENPGFEASPP

AQGIPEAKVRHPLSYVAQRQPSESGRHLLSEPSTPLSPPGPGDVFFPSLD

PVPDSPNFEVI (SEQ ID NO: 1249; C10orf54 Construct 8

(CC8) with human sequence underlined)

The amino acid sequence for chimeric protein encoded by the CC9 expression construct is shown below

MGVPTALEAGSWRWGSLLFALFLAASLGPVAAFKVATPYSLYVCPEGQNV

TLTCRLLGPVDKGHDVTFYKTWYRSSRGEVQTCKEHRPIRNFTLQHLQHH

GSHLKANASHDQPQKHGLELASDHHGNFSITMRNLTLLDSGLYCCLVVEI

RHHHSEHRVHGAMELQVQTGKDAPSNCVVYPSSSQDSENITAAALATGAC

IVGILCLPLILLLVYKQRQAASNRRAQELVRMDSNIQGIENPGFEASPPA

QGIPEAKVRHPLSYVAQRQPSESGRHLLSEPSTPLSPPGPGDVFFPSLDP

VPDSPNFEVI (SEQ ID NO: 1250; C10orf54 Construct 9

(CC9) with mouse sequence underlined)

The amino acid sequence for chimeric protein encoded by the CC10 expression construct is shown below

MGVPAVPEASSPRWGTLLLAIFLAASRGLVAAFKVTTPYSLYVCPEGQNA

TLTCRILGPVSKGHDVTIYKTWYLSSRGEVQMCSERRPIRNLTFQDLHLH

HGGHQAANTSHDLAQRHGLELASDHHGNFSITLRNVTPRDSGLYCCLVIE

LKNHHPEQRFYGSMELQVQAGKGSGSTCMASNEQDSDSITAAALATGACI

VGILCLPLILLLVYKQRQVASHRRAQELVRMDSSNTQGIENPGFETTPPF

QGMPEAKTRPPLSYVAQRQPSESGRYLLSDPSTPLSPPGPGDVFFPSLDP

VPDSPNSEAI (SEQ ID NO: 1251; C10orf54 Construct 10

(CC10) with human sequence underlined)

TABLE 39

| Antibody Designation | C10orf54 Construct Bin | Staining of following Construct IDs |
| --- | --- | --- |
| 5B | a | CC1, CC4, CC5, CC8, CC10 |
| 46A | a | CC1, CC4, CC5, CC8, CC10 |
| 97A | | |
| 128A | a | CC1, CC4, CC5, CC8, CC10 |
| 146C | a | CC1, CC4, CC5, CC8, CC10 |
| 208A | a | CC1, CC4, CC5, CC8, CC10 |
| 215A | b | CC1, CC4, CC5, CC8 |
| 26A | a | CC1, CC4, CC5, CC8, CC10 |
| 164A | a | CC1, CC4, CC5, CC8, CC10 |
| 230A | a | CC1, CC4, CC5, CC8, CC10 |
| 76E1 | b | CC1, CC4, CC5, CC8 |
| 53A | b | CC1, CC4, CC5, CC8 |
| 259A | b | CC1, CC4, CC5, CC8 |
| 33A | a | CC1, CC4, CC5, CC8, CC10 |
| 39A | b | CC1, CC4, CC5, CC8 |
| 124A | b | CC1, CC4, CC5, CC8 |
| 175A | c | CC1, CC4, CC5 |
| 321D | a | CC1, CC4, CC5, CC8, CC10 |
| 141A | d | CC1, CC4, CC5, CC8, CC9 |
| 51A | d | CC1, CC4, CC5, CC8, CC9 |
| 353A | e | CC1, CC3, CC4, CC5, CC8, CC9 |
| 305A | f | CC1, CC4, CC5, CC7, CC9 |

Results of these experiments demonstrate that the anti-C10orf54 antibodies as described herein bind to various epitopes of human C10orf54, including aa33-169, aa84-169, aa115-169, and aa84-115.

Example 5—Preparation of Humanized Antibodies

Murine antibodies prepared as described in Example 3 were selected for sequencing. The selected monoclonal antibodies designated 76E1, 141A and 175A were humanized by two methods as follows. The results of humanization are shown in FIGS. 3-8.

In a first humanization method, most amino acids in each complementarity-determining region (CDR), as previously identified, in the variable heavy (VH) and variable light (VL) domain sequence were converted to alanine. The resulting sequence for VH and for VL as shown in FIG. 9 was used as input to the human subgroup identification algorithm on the website of Dr. Andrew C. R. Martin www.bioinf.org.uk/abs/; this method is a derivation of Deret, S. et al SUBIM: a Program for Analysing the Kabat Database and Determining the Variability Subgroup of a new Immunoglobulin Sequence Comput Appl Biosci 11:435-439 (1995). Antibody 76E1 VH, 141A VH and 175A VH were closest to human VH subgroup I, 76E1 VL and 175A VL were closest to human VL kappa subgroup II, and 141A VL was closest to human VL kappa subgroup III. For each murine 76E1, 141A and 175A VH and VL sequence, a single human VH or VL germ line acceptor sequence was chosen from the corresponding human subgroup germ line sequences and all human joining region sequences compiled at IMGT® the international ImMunoGeneTics information System® www.imgt.org (founder and director: Marie-Paule Lefranc, Montpellier, France).

In a second humanization method (Carter et al., Proc Natl Acad Sci USA 89:4285-4289 (1992)), human VH subgroup III germline was used as acceptor for the murine VH sequences of 76E1 VH, 141A VH and 175A VH; human VL subgroup kappa I was used as acceptor for 76E1 VL, 141A VL and 175A VL.

Alteration of human germline framework (e.g., non-CDR residues in VH and VL) positions to corresponding parental murine 76E1, 141A or 175A sequence might be required to optimize binding of the humanized antibody. Potential changes for each humanized sequence are noted in FIGS. 3-8. Potential changes in the CDR sequences of the humanized antibodies in order to alleviate complications due to deamidation of solvent-exposed asparagines, oxidation of solvent-exposed methionines, and formation of isoaspartic acid are also noted in FIGS. 3-8.

Computer-graphics models of murine 76E1, 141A and 175A VH and VL domains were generated to aid in selection of CDR and framework residues that might require alteration. The Swiss-PdB Viewer program was used (Guex, N and Peitsch, M C SWISS-MODEL and the Swiss-PdB-Viewer: An environment for comparative protein modeling. Electrophoresis 18:2714-2723 (1997) Expasy website. Crystal structures of antibodies were taken from the Protein Data Bank website (Berman, H M; Westbrook, J; Feng, Z; Gilliland, G; Bhat, T N; Weissig, H; Shindyalov, I N; Bourne P E, The Protein Data Bank Nucleic Acids Research 28:235-242 (2000). The sequences of humanized 76E1, 141A and 175A VH and VL domains are shown in FIGS. 3-8.

Additional humanized anti-C10orf54 antibodies are prepared comprising a VH domain, VL domain, VH CDR1, VH CDR2, VH CDR3, VL CDR1, VL CDR2, and/or VL CDR3 as shown in Tables 12-33. For example, selected murine monoclonal antibodies designated 26A, 128A, 124A and 259A were humanized by the following method, the results of which are shown in FIGS. 22A, 22B, 23A, 23B, 24A, 24B, 25A and 25B. The CDR sequences and VH/VL sequences for antibodies designated 26A, 128A, 124A and 259A are shown in Tables 19, 15, 27 and 24, respectively.

The sequences of the VH and VL of each murine monoclonal antibody was used as input to the IgBLAST program on the NCBI website (http://www.ncbi.nlm.nih.gov/igblast/; Ye, J. et al. Nucleic Acids Research 41:W34-W40 (2013)). IgBLAST takes a murine VH or VL sequence and compares it to a library of known human germline sequences. The databases used were IMGT human VH genes (F+ORF, 273 germline sequences) and IMGT human VLkappa genes (F+ORF, 74 germline sequences). IgBLAST returned the top 10 human germline sequences according to score.

For all four VHs of 26A, 128A, 124A and 259A, human germline IGHV1-46(allele 1) was chosen as the acceptor sequence and the human heavy chain IGHJ4(allele 1) joining region (J gene) was chosen from human joining region sequences compiled at IMGT® the international ImMunoGeneTics information System® www.imgt.org (see FIGS. 22A, 23A, 24A, and 25A).

For 26A VL, human germline IGKV43-11(allele 1) was chosen as the acceptor sequence and human light chain IGKJ2(allele 1) joining region (J gene) was chosen from human joining region sequences compiled at IMGT® the international ImMunoGeneTics information System® www.imgt.org (see FIG. 22B).

For 128A VL, human germline IGKV1-39(allele 1) was chosen as the acceptor sequence and human light chain IGKJ2(allele 1) as the joining region (J gene) (see FIG. 23B).

For 124A VL, human germline IGKV2-30(allele 1) was chosen as the acceptor sequence and human light chain IGKJ2(allele 1) as the joining region (J gene) (see FIG. 24B).

For 259A VL, human germline IGKV2-28(allele 1) was chosen as the acceptor sequence and human light chain IGKJ2(allele 1) as the joining region (J gene) (see FIG. 25B).

Example 6—Anti-Tumor Activity

Anti-C10orf54 antibodies were tested for their anti-tumor activity in an animal tumor model. For these studies, the cell line Kasumi-3 (acute myeloid leukemia), was obtained from ATCC (CRL-2725) and cultured according to the suppliers' protocols. Animals were obtained from Taconic (Hudson, N.Y.). Studies were conducted with anti-C10orf54 antibodies in an animal tumor model.

In these experiments, 4-6 week-old immunodeficient NOD-SCID female mice were used for the Kasumi-3 tumor model. Mice were subcutaneously injected on the right flank with $1.2 \times 10^6$ viable cells (Kasumi-3) in a mixture of PBS (without magnesium or calcium) and BD Matrigel (BD Biosciences) at a 1:1 ratio. The injected total volume per mouse was 200 µl with 50% being Matrigel (BD Biosciences). Once the tumor reached a size between 65-200 mm³ mice were randomized. Antibodies were administered weekly at 15 mg/kg for four weeks, bodyweights and tumors measured once and twice weekly, respectively. Tumor volume was calculated as described (van der Horst et al., 2009, Neoplasia 11(4):355-364). Experiments were performed on groups of at least 8 animals per experimental point.

Statistical significance between treatment and control groups was calculated using the Graphpad Prism software package and applying Student's two-tailed t-test. A p-value of less than 0.05 was considered significant. The results of three exemplary experiments are shown in Table 40. For Experiment 1, tumor volumes at which treatment was initiated were 114.7 mm3 (day 96). For Experiment 2, tumor volumes at which treatment was initiated were 114.5 mm3 (day 103). For Experiment 3, tumor volumes at which treatment was initiated were 133 mm3 (day 34).

TABLE 40

| Treatment | Volume ± SD [mm³] | TGI [%] | P-value |
|---|---|---|---|
| EXPERIMENT 1 | | | |
| CTRL IgG | 3255 ± 1704 | — | — |
| 175A | 833 ± 429 | −77 | 0.0088 |
| 124A | 1305 ± 674 | −62 | 0.0363 |
| 33A | 1514 ± 1156 | −55 | 0.0447 |
| 51A | 1668 ± 638 | −51 | 0.0507 |
| 46A | 1925 ± 791 | −42 | 0.0937 |
| 26A | 1982 ± 997 | −41 | 0.1154 |
| 39A | 2039 ± 1102 | −39 | 0.1370 |
| EXPERIMENT 2 | | | |
| CTRL IgG | 2689 ± 866 | — | — |
| 141A | 1271 ± 962 | −55 | 0.0079 |
| 164A | 1638 ± 553 | −41 | 0.0136 |
| 128A | 2119 ± 1340 | −22 | 0.3585 |
| 321D | 2588 ± 1371 | −4 | 0.8638 |
| EXPERIMENT 3 | | | |
| CTRL IgG | 1961 ± 1060 | — | — |
| 175A | 344 ± 841 | −81 | 0.0342 |

Figure 10:
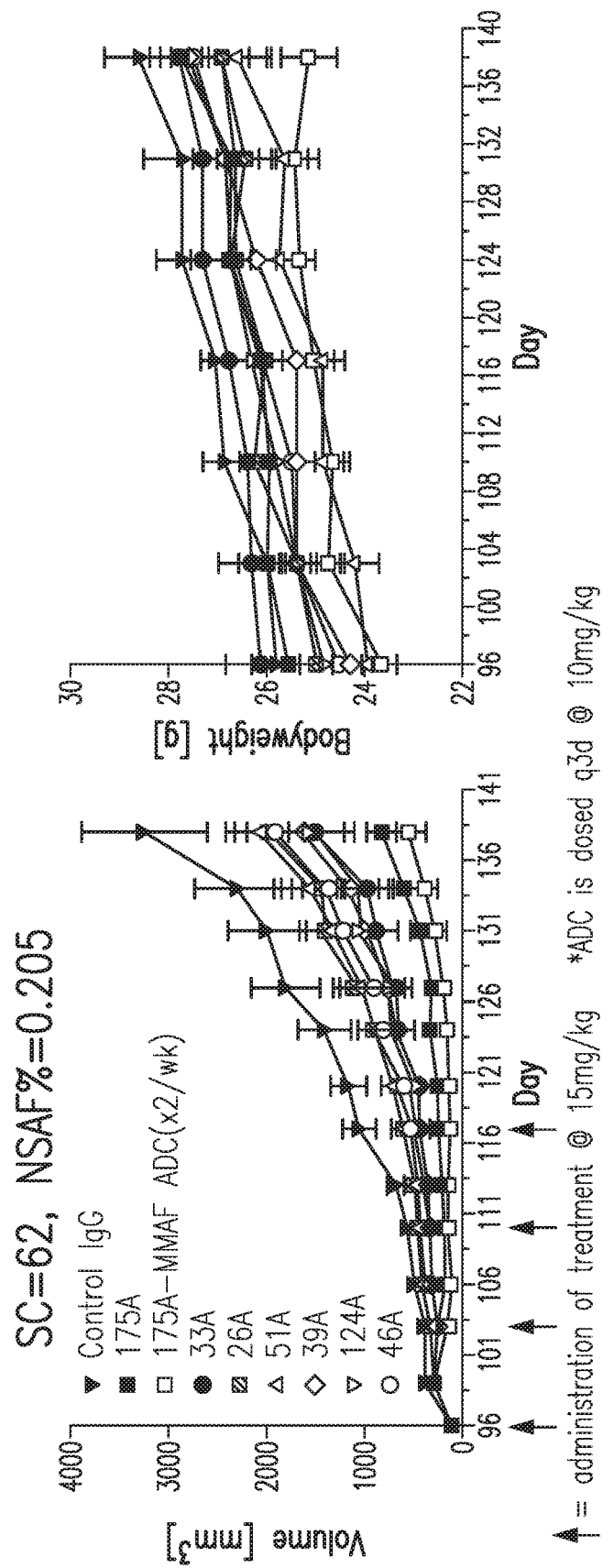
FIG. 10 shows anti-C10orf54 antibody treatment induces strong tumor growth inhibition in established Kasumi-3 tumors.
Figure 11:
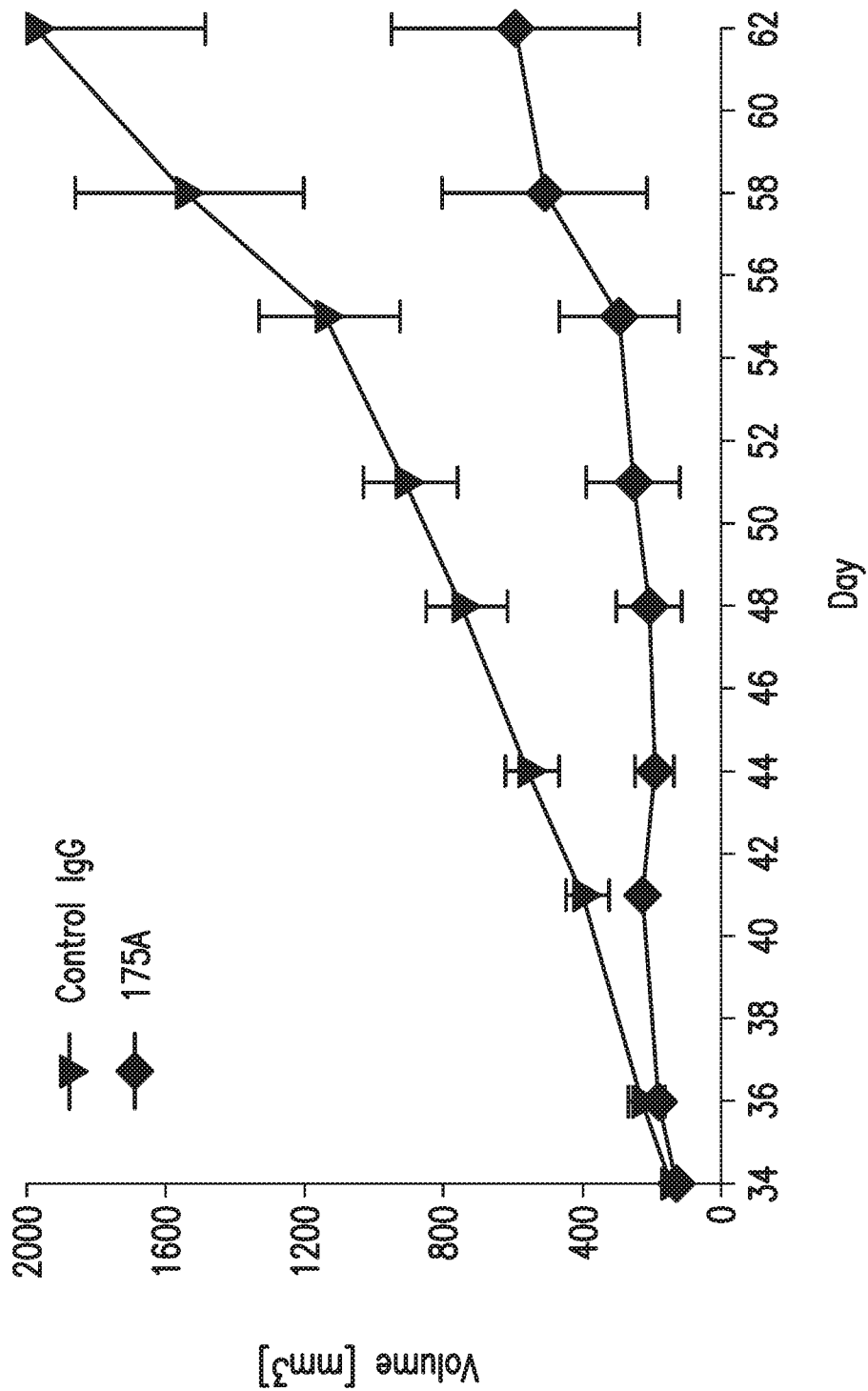
FIG. 11 shows murine 175A anti-C10orf54 antibody treatment induces strong tumor growth inhibition in established Kasumi-3 tumors.

As shown in FIG. 10 (see also, Table 40, Experiment 1), anti-C10orf54 antibody treatment induced strong tumor growth inhibition in established Kasumi-3 tumors. None of the antibody treatments had significant effect on body-weight, which indicates that the antibody treatment was not toxic. As shown in FIG. 11 (see also, Table 40, Experiment 3), antibody treatment again with antibody 175A induces strong tumor growth inhibition in established Kasumi-3 tumors.

Example 7—Preparation and Use of Antibody-Drug Conjugates

Antibody-drug conjugates (ADCs) were prepared and used in secondary ADC assays and direct ADC assays with antibodies to C10orf54, as illustrated in the following exemplary generic Scheme A, where a maleimido group is attached through a linker (L) to a cytotoxin (CTX):

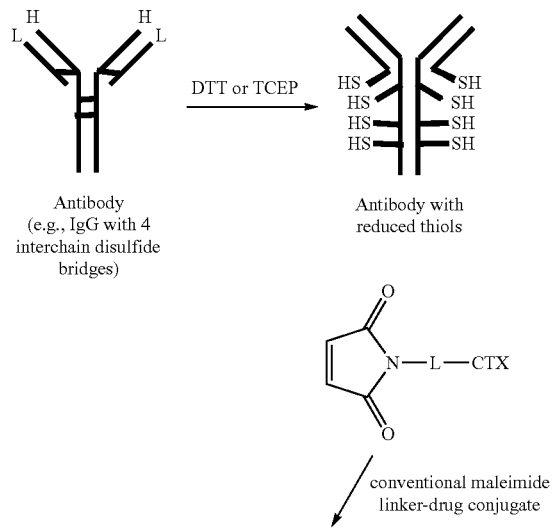

Scheme A: ADCs with conventional maleimide linker-drug conjugates

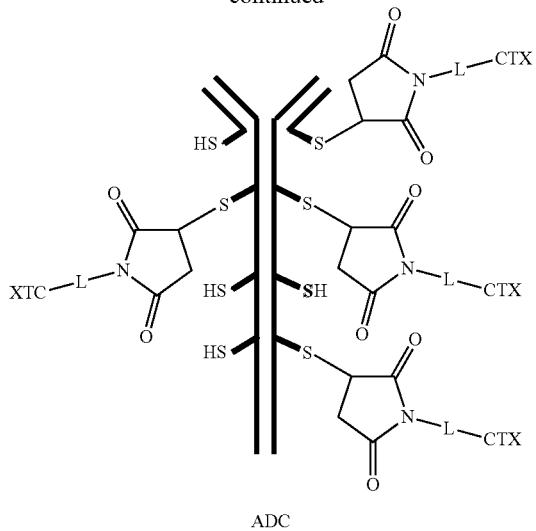

ADC

For example, according to Scheme A above, L may be one of the following:
(i) —(CH₂)₅—C(O)—; (ii) —(CH₂)₅—C(O)-Valine-Citrulline; (iii) —(CH₂)₅—C(O)-Valine-Alanine; (iv) —(CH₂)₅—C(O)-Valine-Citrulline-phenylenyl, where the phenylenyl is substituted by 2 substituents selected from the group consisting of —C(O)OH and —NH₂; (v) —(CH₂)₅—C(O)-Valine-Alanine-phenylenyl, where the phenylenyl is substituted by 2 substituents selected from the group consisting of —C(O)OH and —NH₂; (vi) —(CH₂CH₂)—(CH₂CH₂O)₄—C(O)-Valine-Citrulline-phenylenyl, where the phenylenyl is substituted by 2 substituents selected from the group consisting of —C(O)OH and —NH₂; or (vii) —(CH₂CH₂)—(CH₂CH₂O)₄—C(O)-Valine-Alanine-phenylenyl, where the phenylenyl is substituted by 2 substituents selected from the group consisting of —C(O)OH and —NH₂.

For example, according to Scheme A above, L may be one of the following: (i) caproyl ("c"); (ii) caproyl-Valine-Citrulline ("cValCit"); (iii) caproyl-Valine-Alanine ("cValAla"); (iv) caproyl-Valine-Citrulline-para aminobenzyl ("cValCit-PAB"); (v) caproyl-Valine-Alanine-para aminobenzyl ("cValAla-PAB"); (vi) (dPEG)₄-Valine-Citrulline-para aminobenzyl ("dPEG₄-ValCit-PAB"); or (vii) (dPEG)₄-Valine-Alanine-para am inobenzyl ("dPEG₄-ValAla-PAB").

For example, when the antibody-drug conjugate is prepared using a maleimido group ("m"), attached through the linker to a cytotoxin, CTX, as illustrated in Scheme A above, the antibody-drug conjugate may comprise one of the following: (i) maleimidocaproyl ("mc"); (ii) maleimidocaproyl-Valine-Citrulline ("mcValCit"); (iii) maleimidocaproyl-Valine-Alanine ("mcValAla"); (iv) maleimidocaproyl-Valine-Citrulline-para am inobenzyl ("mcValCit-PAB"); (v) maleimidocaproyl-Valine-Alanine-para aminobenzyl ("mcValAla-PAB"); (vi) maleimidocaproyl-(dPEG)₄-Valine-Citrulline-para aminobenzyl ("m-dPEG4-ValCit-PAB"); or (vii) maleimidocaproyl-(dPEG)₄-Valine-Alanine-para aminobenzyl ("m-dPEG4-ValAla-PAB").

As illustrated in the following Schemes B-F, the antibody-drug conjugate of Scheme A above may be prepared using using maleimidocaproyl-monomethylauristatin F ("mc-MMAF"), maleimidocaproyl-Valine-Citrulline-para aminobenzyl-monomethylauristatin F ("mcValCit-PAB- MMAF"), maleimidocaproyl-Valine-Citrulline-para aminobenzyl-monomethylauristatin E ("mcValCit-PAB-MMAE"), maleimidocaproyl-(dPEG)₄-Valine-Citrulline-para aminobenzyl-CC1065 ("m-dPEG₄-ValCit-PAB-CC1065"), or maleim idocaproyl-Valine-Alanine-pyrrolobenzodiazepine ("mcValAla-PBD").

Exemplary antibody-drug conjugates are prepared using maleimidocaproyl-monomethylauristatin F (mc-MMAF), as illustrated in the following Scheme B, where the maleimido group is attached through a linker (L=caproyl group) to a cytotoxin (CTX=MMAF):

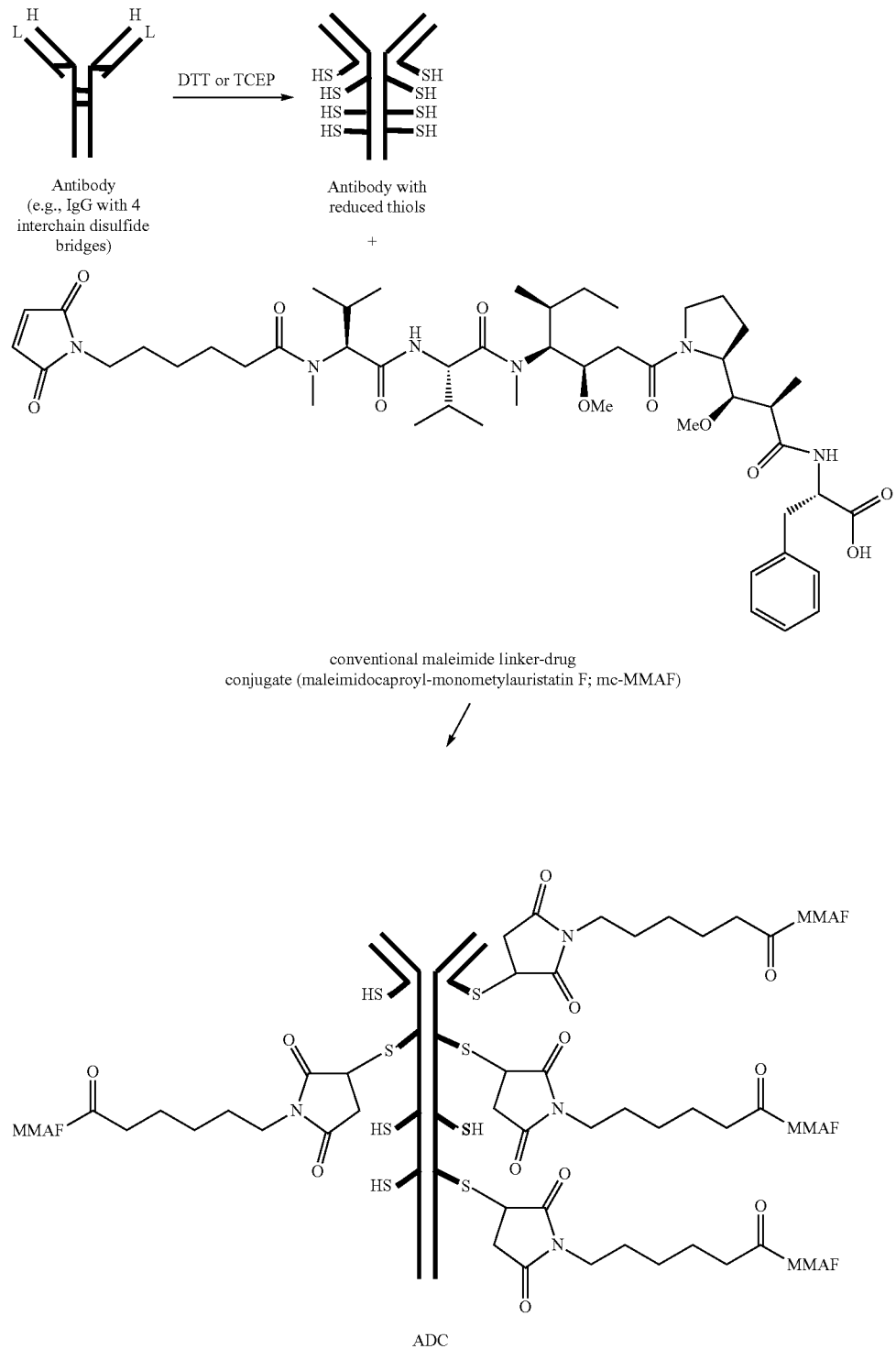

Exemplary antibody-drug conjugates are also prepared using maleimidocaproyl-Valine-Citrulline-para aminobenzyl-monomethylauristatin F (mcValCit-PAB-MMAF), as illustrated in the following Scheme C, where the maleimido group is attached through a linker (L=caproyl-Valine-Citrulline-para aminobenzyl) to a cytotoxin (CTX=MMAF):

Scheme C ADCs conjugated with mcValCit-PAB-MMAF

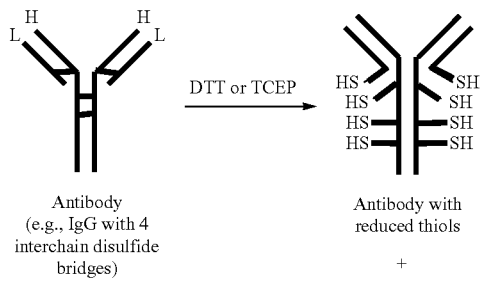

Antibody (e.g., IgG with 4 interchain disulfide bridges)

Antibody with reduced thiols

+

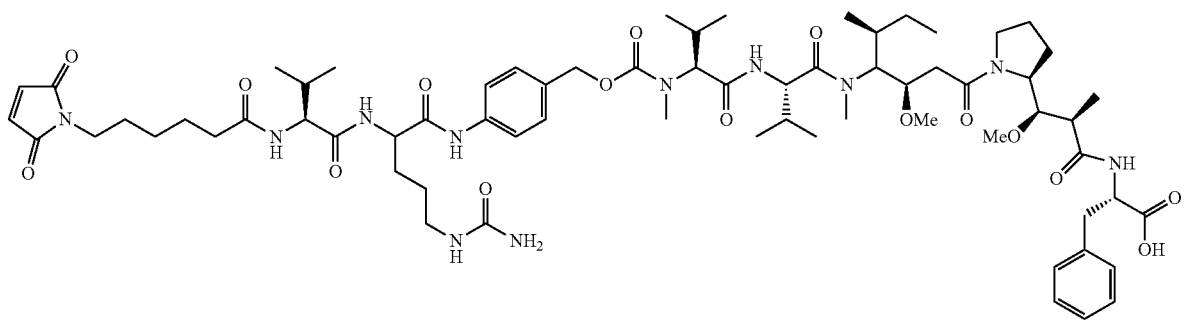

conventional maleimide linker-drug conjugate (maleimidocaproyl-Valine-Citrulline-para aminobenzyl-monomethylauristatin F; mcValCit-PAB-MMAF)

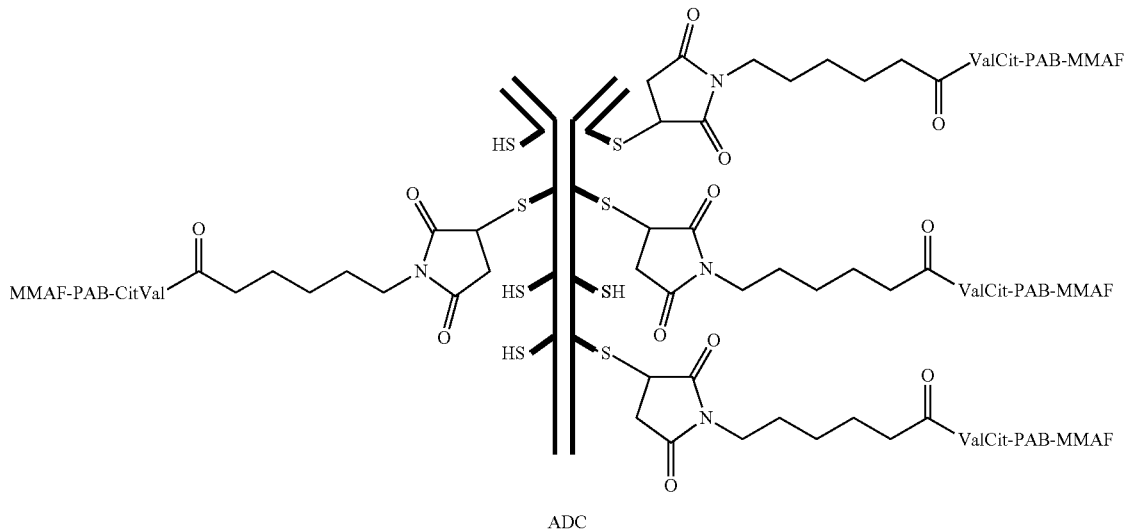

ADC

Exemplary antibody-drug conjugates are also prepared using maleimidocaproyl-Valine-Citrulline-para aminobenzyl-monomethylauristatin E (mcValCit-PAB-MMAE), as illustrated in the following Scheme D, where the maleimido group is attached through a linker (L=caproyl-Valine-Citrulline-para aminobenzyl) to a cytotoxin (CTX=MMAE):

Scheme D ADCs conjugated with mcValCit-PAB-MMAE

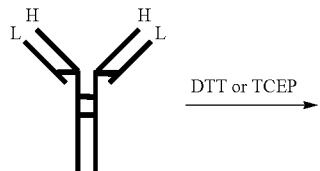

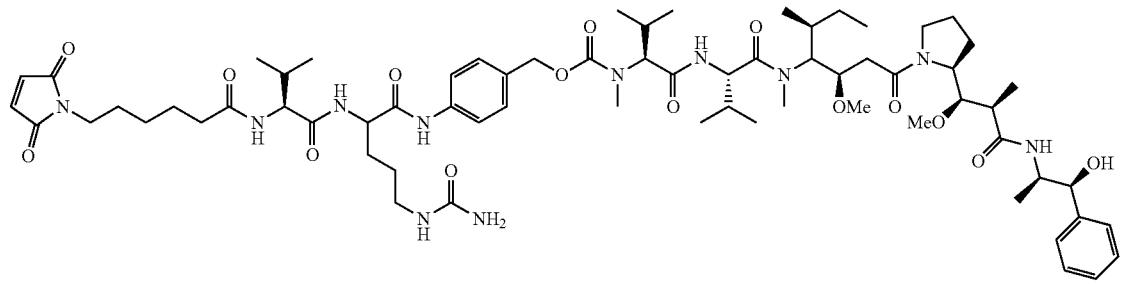

conventional maleimide linker-drug conjugate (maleimidocaproyl-Valine-Citrulline-para aminobenzyl-monomethylauristatin E; mcValCit-PAB-MMAE)

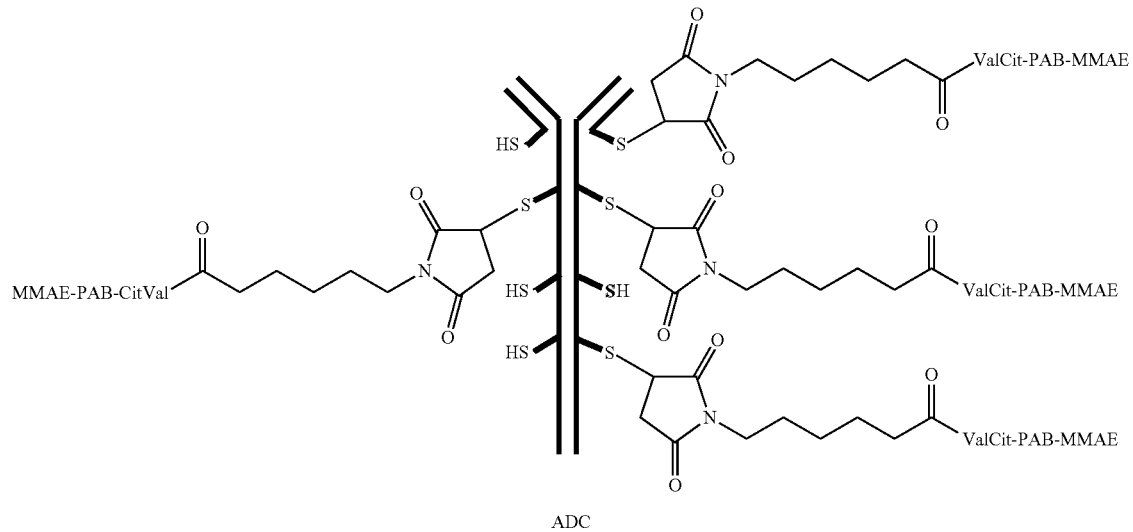

ADC

Exemplary antibody-drug conjugates are also prepared using maleimidocaproyl-(dPEG)₄-Valine-Citrulline-para aminobenzyl-CC1065 (m-dPEG₄-ValCit-PAB-CC1065), as illustrated in the following Scheme E, where the maleimido group is attached through a linker (L=(dPEG)₄-Valine-Citrulline-para aminobenzyl) to a cytotoxin (CTX=CC1065):

Scheme E ADCs conjugated with m-dPEG₄-ValCit-PAB-CC1065

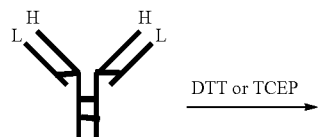

Antibody
(e.g., IgG with 4 interchain disulfide bridges)

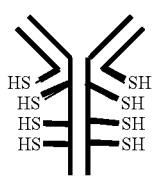

Antibody with reduced thiols

+

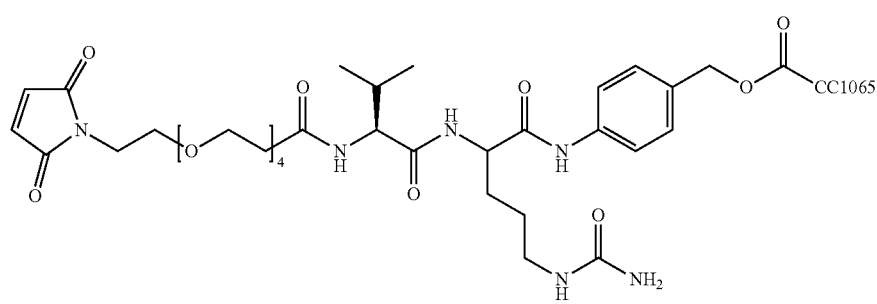

conventional maleimide linker-drug
conjugate (maleimidocaproyl-(dPEG)₄-Valine-Citrulline-para aminobenzyl-CC1065; m-dPEG₄-ValCit-PAB-CC1065)

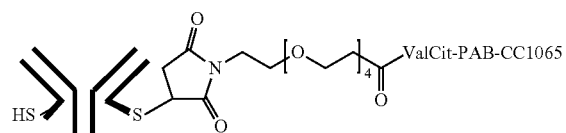

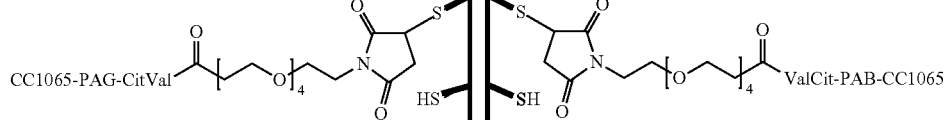

ADC

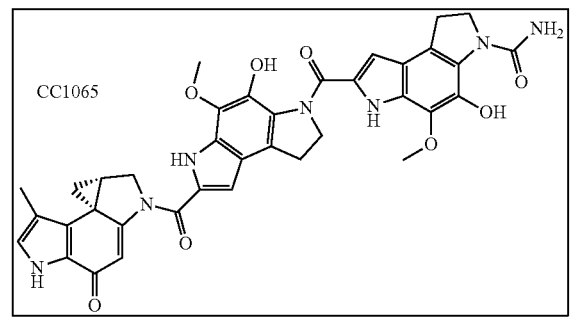

In Scheme E, the structure of the cyclophosphamide, CC1065, is depicted in the lower left-hand corner of the scheme, with an arrow indicating the point of attachment (e.g., via the free amino group on the CC1065 molecule) to the carbonyl group of the para aminobenzoate moiety of the linker.

Exemplary antibody-drug conjugates are also prepared using maleimidocaproyl-Valine-Alanine-pyrrolobenzodiazepine (mc-ValAla-PDB), as illustrated in the following Scheme F, where the maleimido group is attached through a linker (L=caproyl-Valine-Alanine) to a cytotoxin (CTX=PDB):

The ADCs of exemplary Schemes B-F were made as follows. In a sterile 1.7 ml eppendorf tube, 20 mg of antibody at 20 mg/ml concentration in phosphate buffered saline (PBS) pH 7.4 (Gibco, Mg and Ca free) was reacted with 1 mM diethylene triamine pentaacetic acid (DTPA) as the chelator. Then 2.75 eq. of tris(2-carboxyethyl)phosphine hydrochloride solution (TCEP HCl) (Sigma ampule 0.5M concentration) or 50 µL of 100 mM dithiothreitol (DTT) was added for an average drug-antibody ratio (DAR) of 4 drugs per antibody and incubated at 37° C. for 1 hour, with the aim of having less than 10% of the total antibody being in the unlabeled or naked antibody.

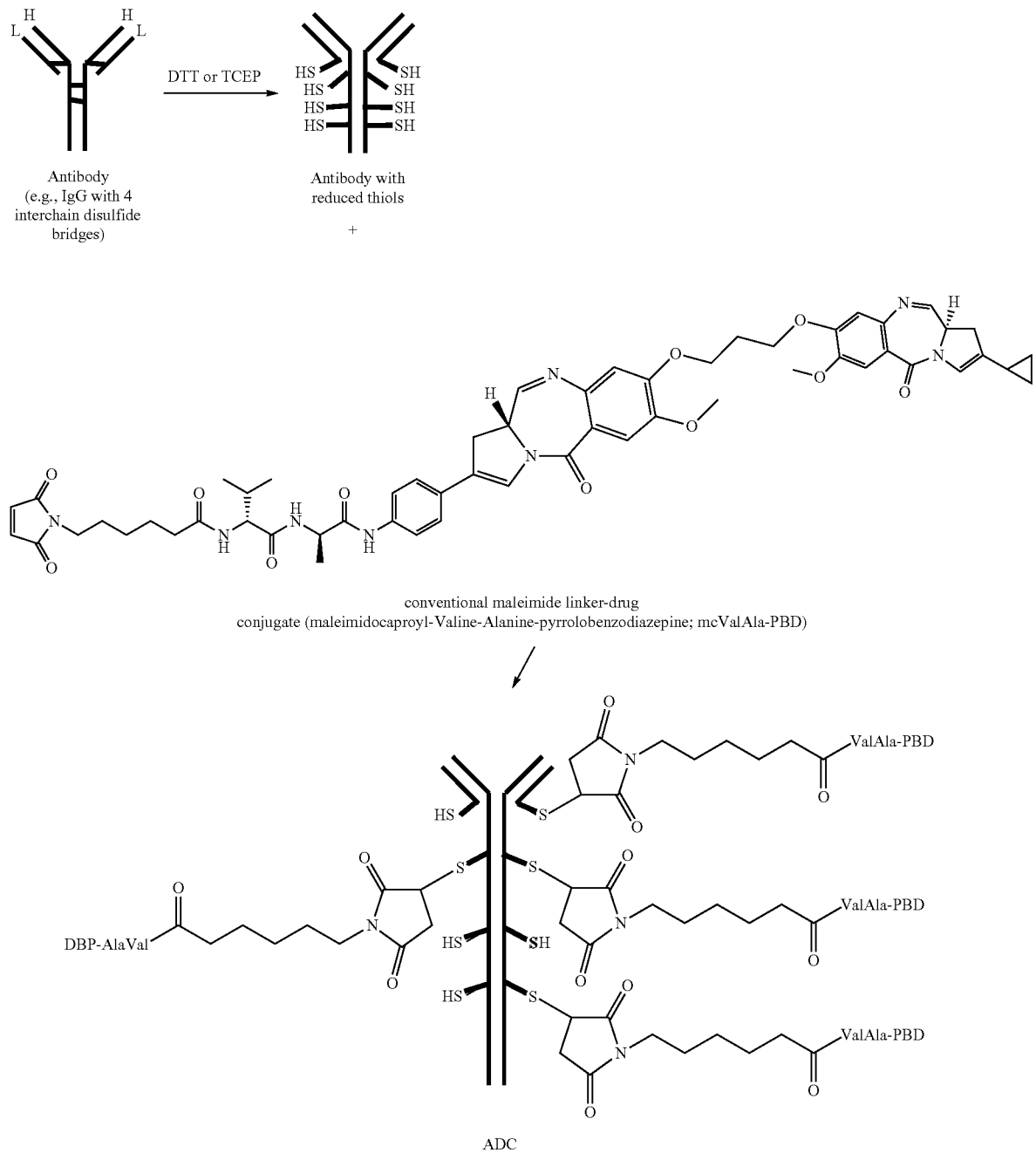

Scheme F: ADCs conjugated with mcValAla-PBD

Dithiobisnitro-benzoate (DTNB; Ellman's reagent) colorimetric assay was used to assess free thiols available for conjugation (Ellman et al., *Biochemical Pharmacology* 7:88-95 (1961)). The reduced antibody solution was cooled in an ice-bath at ~0° C. for 15 minutes. Then, linker-cytotoxin conjugate was added to the reduced antibody solution as follows: (i) for Scheme B, 60 μL of mc-MMAF from a 10 mM stock solution in DMSO (9.74 mg in 1.074 ml of DMSO for 10 mM) was added; (ii) for Scheme C, 60 μL of mcValCit-PAB-MMAF from a 10 mM stock solution in DMSO (9.4 mg in 707 μL of DMSO for 10 mM) was added; (iii) for Scheme D, 60 μL of mcValCit-PAB-MMAE from a 10 mM stock solution in DMSO (3.24 mg in 247 μL of DMSO for 10 mM) was added; (iv) for Scheme E, 60 μL of mc-dPEG$_4$-ValCit-PAB-CC1065 from a 10 mM stock solution in DMSO (3.8 mg in 258 μL of DMSO for 10 mM) was added; and (v) for Scheme F, 60 μL of mc-ValAla-PBD from a 10 mM stock solution in DMSO is added. Once the linker-cytotoxin conjugate was added to the reduced antibody solution, the solution was incubated on a roller-plate in a refrigerator at 4° C. overnight (or alternatively at 37° C. for 2 hours) to produce the ADC. The DTNB assay was repeated to demonstrate no free thiols remaining (clear means no free thiol and a yellow color indicates remaining free thiols and incomplete conjugation of payload). The concentration of the ADC was obtained via the NanoDrop spectrophotometer. The crude ADC was purified using either PD-10 SEC separation or SEC chromatography via a Superdex 200 column eluted with an appropriate working buffer or final formulation buffer. The purified ADC was stored at 4° C.

Hydrophobic Interaction Chromatography (HIC) HPLC method was used to determine average drug loads of the ADCs via HPLC. On an Agilent 1200 HPLC binary pump system attached to a Agilent 6130b Electrospray Mass Spectrometer, a Tosoh NPR Butyl-C4 column (2.1 mm×75 mm) was run with a binary gradient at 0.8 ml/min with diode-array UV-vis detection at 220 nm, 254 nm and 280 nm. Mobile phase A was 1.5M Sodium Sulfate in 1×PBS, Mobile phase B was 1×PBS with 25% isopropanol run on a 0-100% linear gradient for 10-12 column volumes with a 5 minute initial equilibration and 5 minute 100% mobile phase B wash at the end of each HPLC run. Unlabeled or naked antibody eluted first in the linear gradient with peaks representing increasing average drug loads in order of hydrophobicity which correlates with increasing loading of antibody with payloads. Retention times of the naked antibody were confirmed via running a standard injection of 20λ of a 1 mg/ml stock solution of the antibody. Co-elution of the naked antibody and ADC definitively confirmed relative amounts of each.

Figure 12:
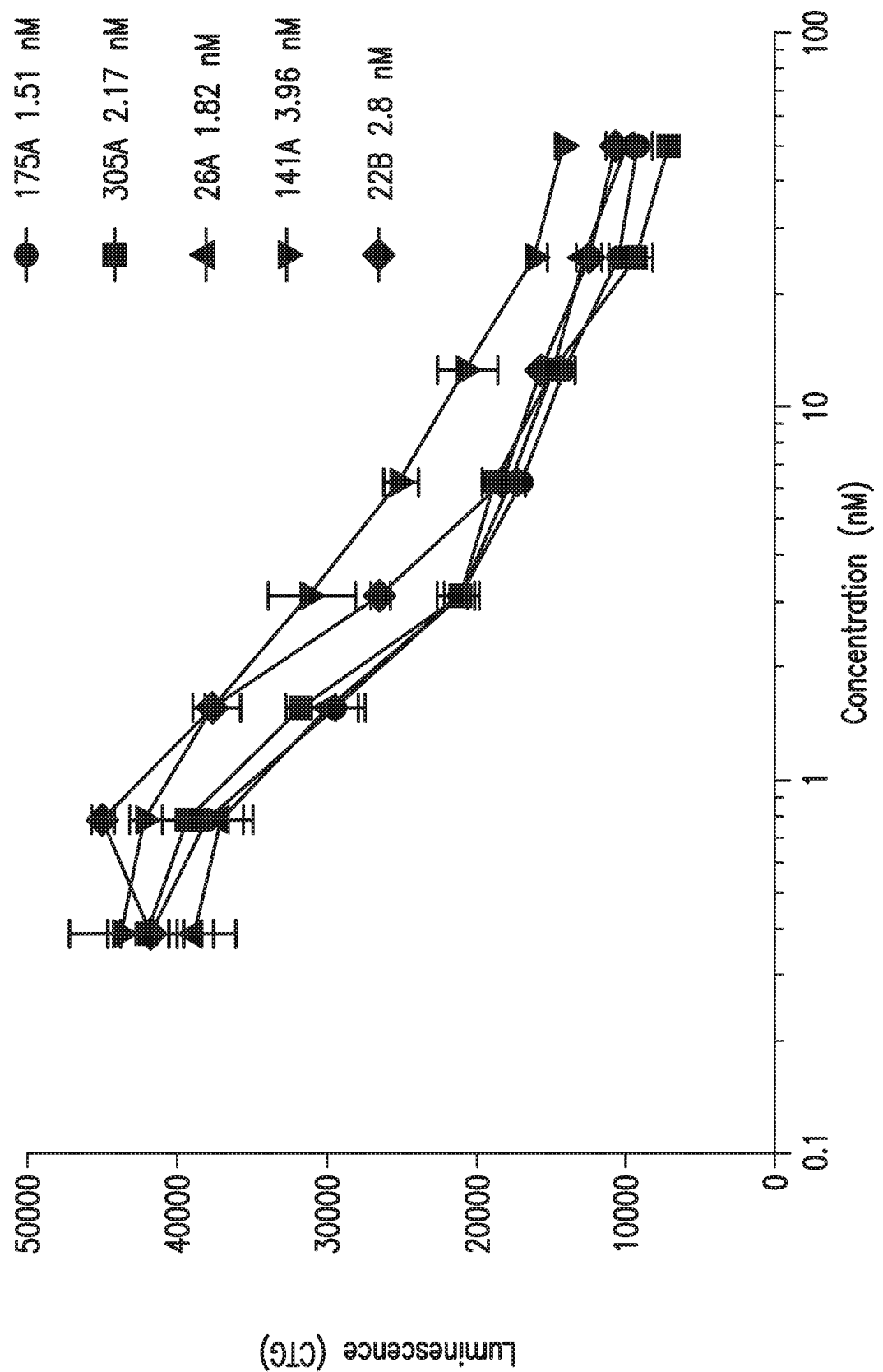
FIG. 12 shows results of a secondary ADC assay using anti-C10orf54 antibodies in a cell viability assay with C10orf54 expressing sarcoma line.

FIG. 12 shows the results of a secondary ADC assay using anti-C10orf54 antibodies in a cell viability assay using a C10orf54 expressing sarcoma line. Anti-C10orf54 antibodies were incubated at a 2:1 ratio with a secondary goat anti mouse antibody conjugated with MMAF. Cells were plated at 1000 cells/well and incubated in the presence of antibodies for 72 hours. The C10orf54 expressing sarcoma cells were killed by the anti-C10orf54 antibodies tested in a concentration-dependent manner.

Figure 13:
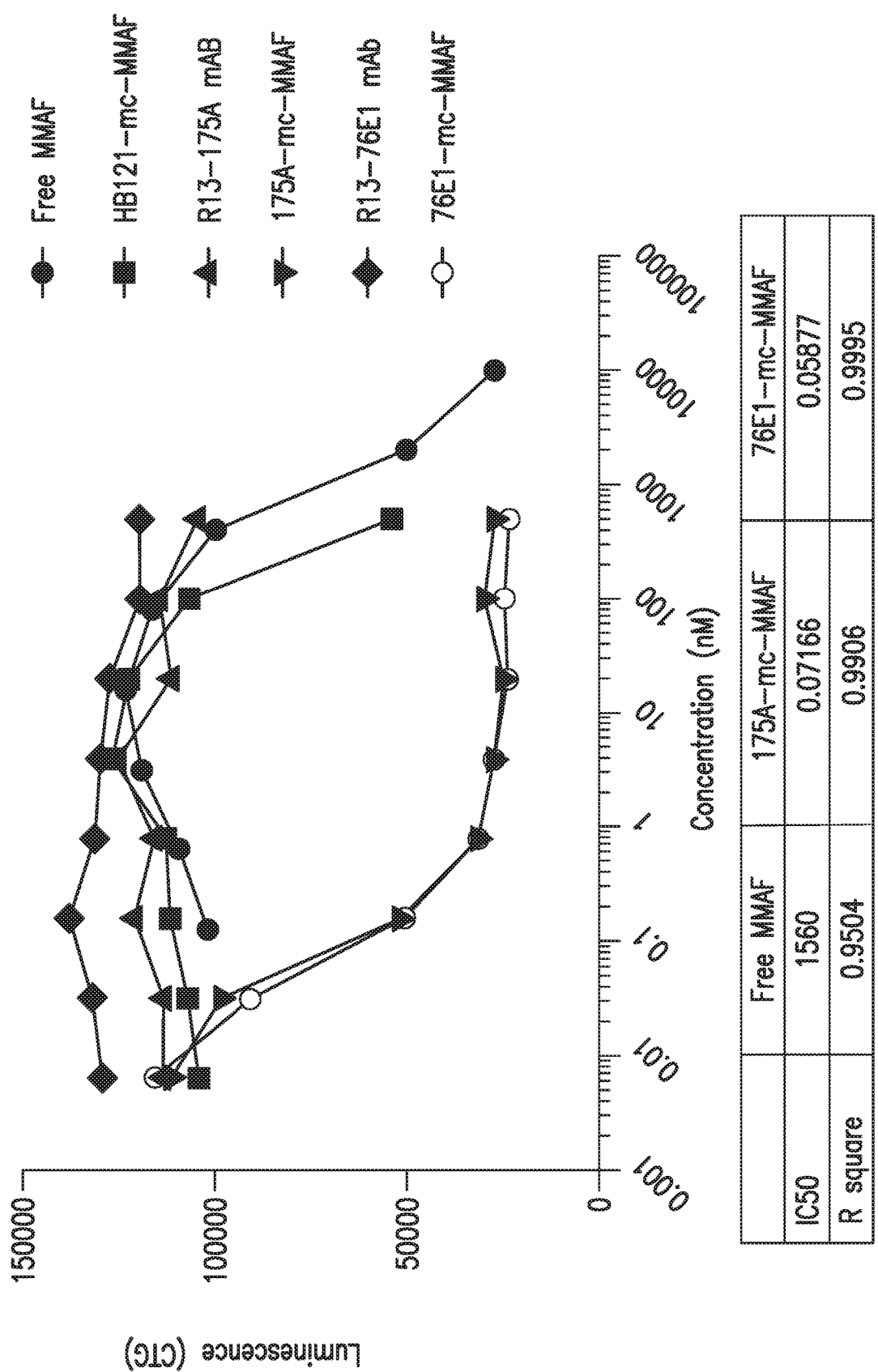
FIGS. 13 and 14 show activity of unconjugated and MMAF conjugated anti-C10orf54 antibodies in a cell viability assay using C10orf54 expressing sarcoma lines and parental sarcoma line.
Figure 14:
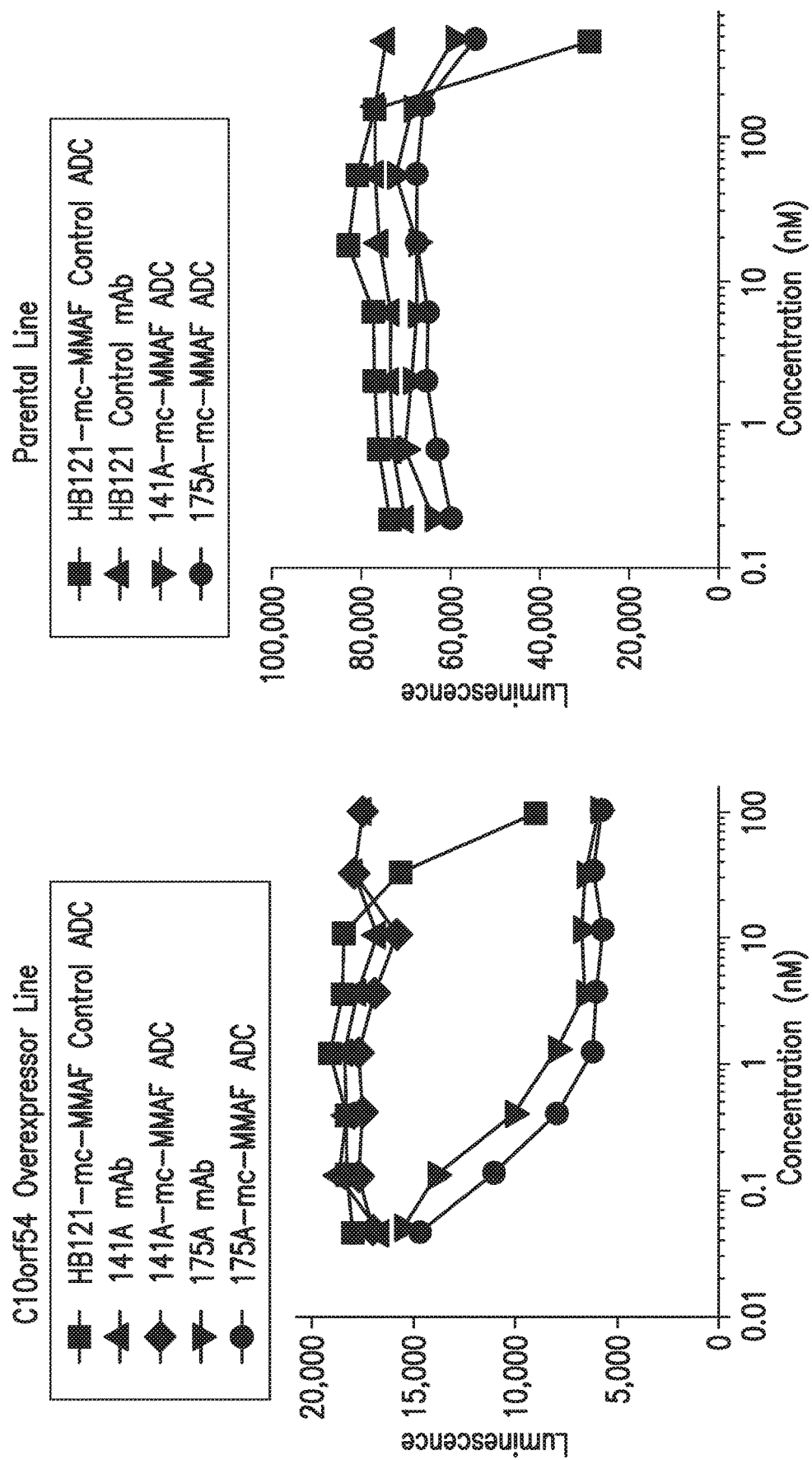

FIGS. 13-14 show the activity of unconjugated and anti-C10orf54 antibodies directly conjugated with MMAE in cell viability assays using C10orf54 expressing sarcoma lines. For these assays, cells may be plated in varying numbers in the wells and are incubated for various times in the presence or absence of anti-C10orf54 antibodies and ADCs. For example, for the assays shown in FIG. 13, cells were plated at 1000 cells/well and incubated in the presence of antibodies for 72 hours. In these in vitro cell-based assays, the MMAF conjugated anti-C10orf54 antibodies killed the sarcoma cells in a concentration-dependent manner.

Figure 15:
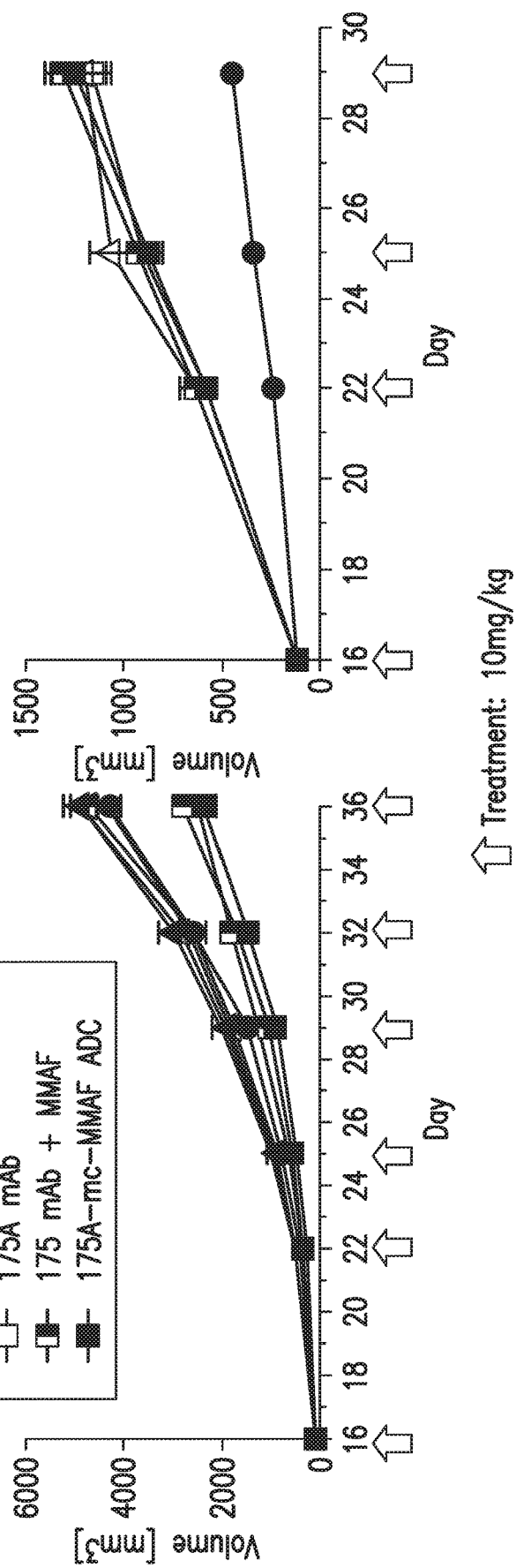
FIG. 15 shows results of treatment with unconjugated and MMAF conjugated anti-C10orf54 antibodies in a tumor model using a C10orf54 expressing sarcoma line and parental sarcoma line.
Figure 16B:
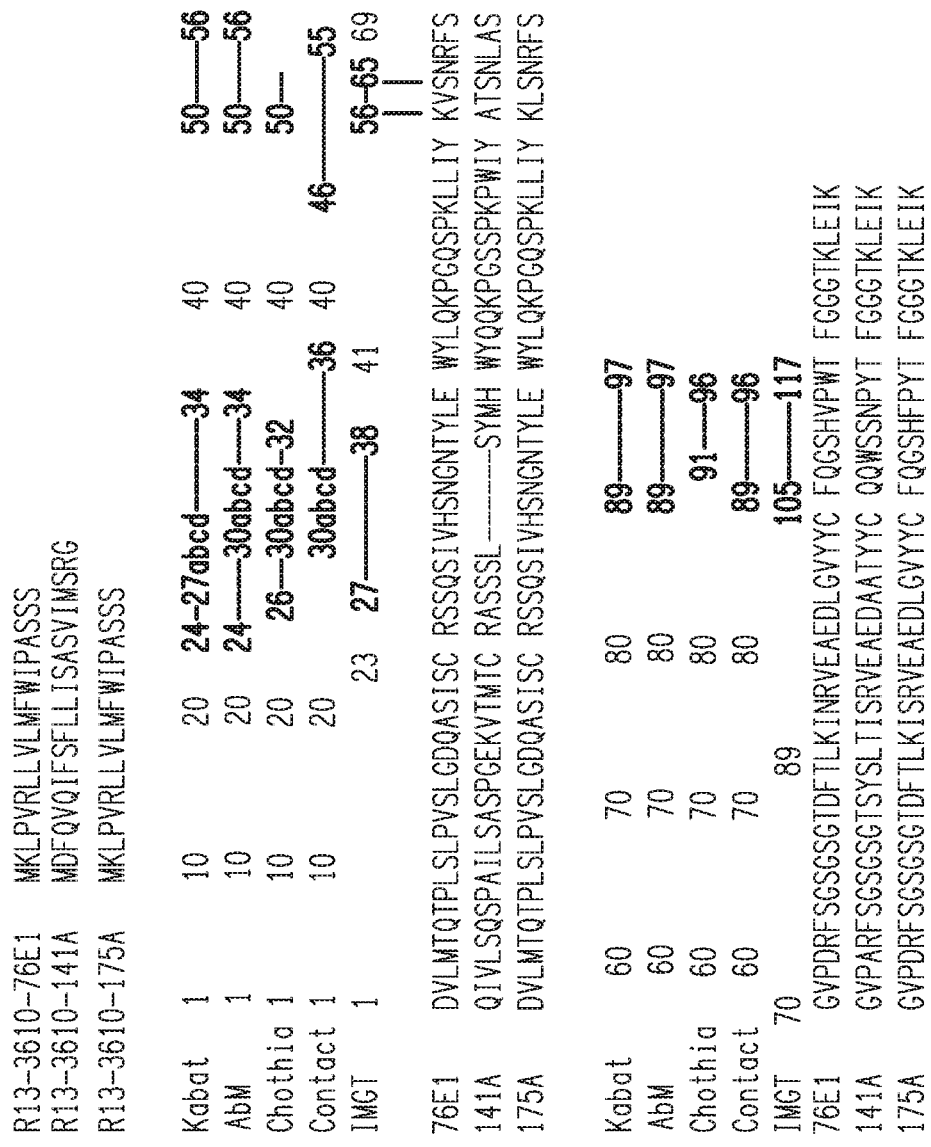
Figure 21A:
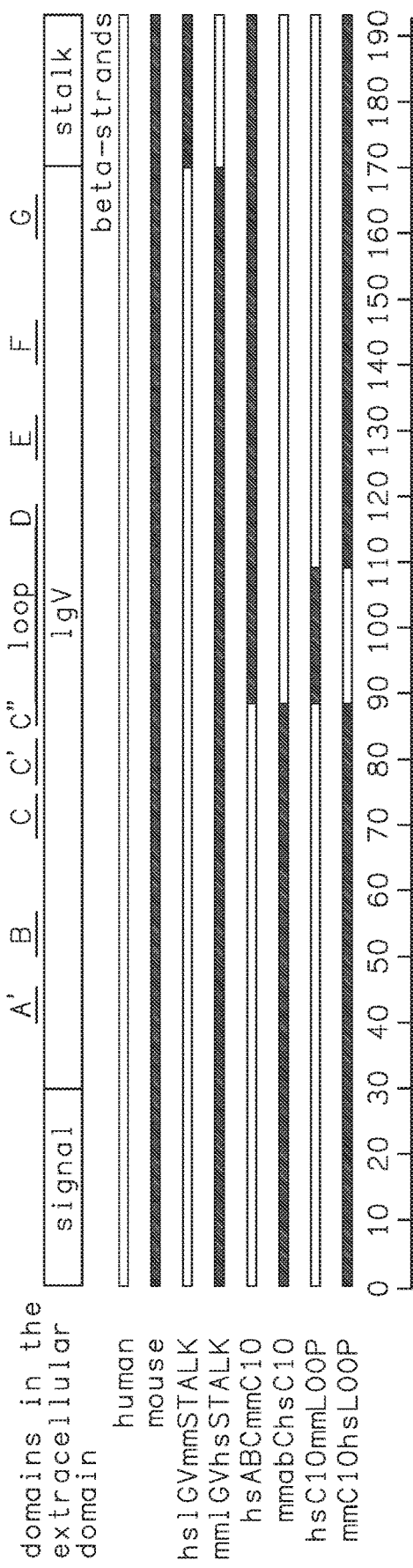
FIG. 21A shows a graphical depiction of C10orf54 protein and chimeric protein constructs. Designation "Human" refers to construct CC1; "Mouse" refers to construct CC2; "hsIGVmmSTALK" refers to construct CC5; "mmIGVhsSTALK" refers to construct CC6; "hsABCmmC10" refers to construct CC7; "mmabChsC10" refers to construct CC8; "hsC10mmLOOP" refers to construct CC9; and "mmC10hsLOOP" refers to construct CC10, as described in Example 3. A sequence alignment of amino acid sequences from human C10orf54 (residues 1 to 193 of SEQ ID NO:1079) and mouse C10orf54 (residues 1 to 190 of SEQ ID NO: 1243), including a consensus sequence of these residues (SEQ ID NO: 1914), are also depicted.
Figure 21B:
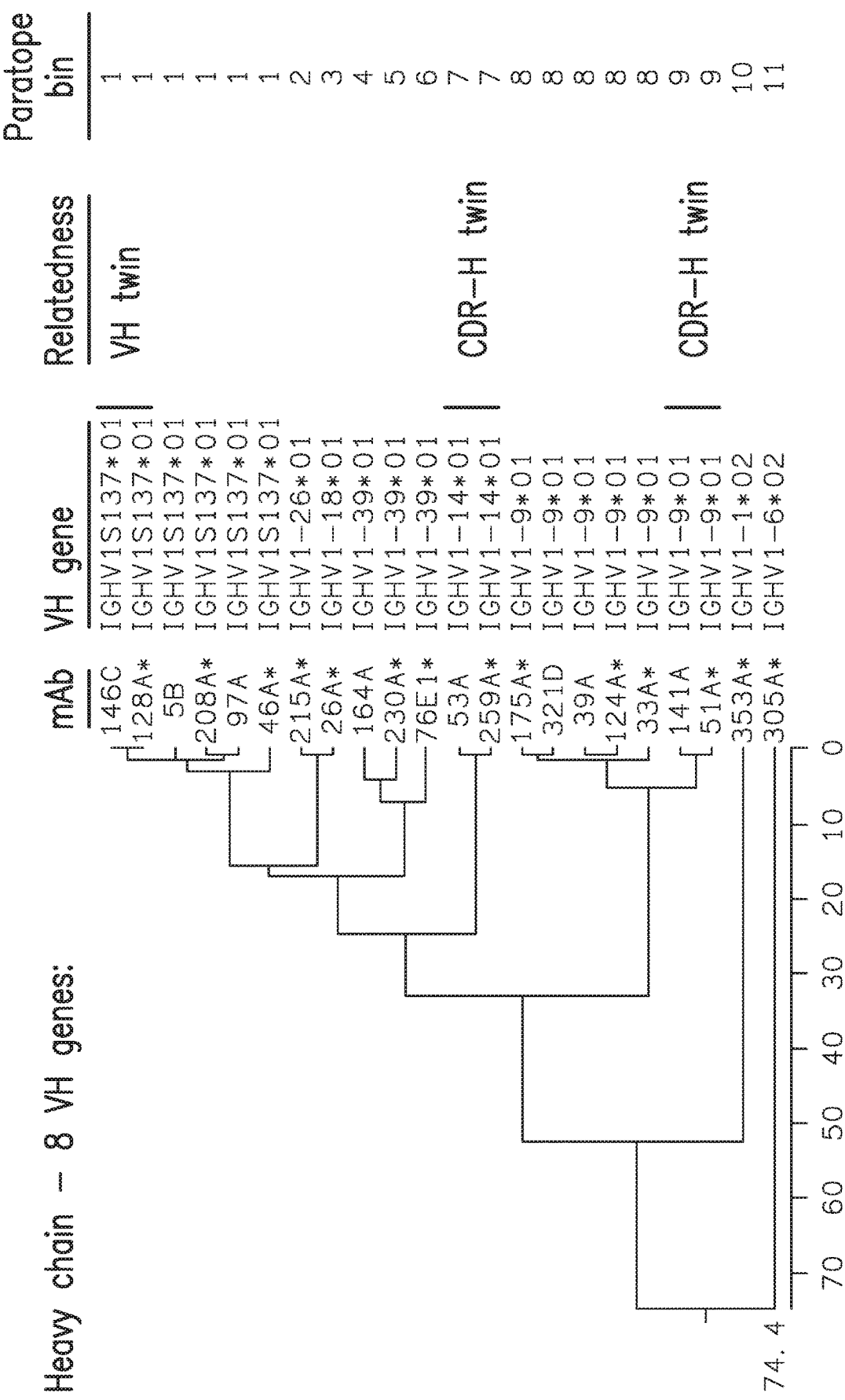
FIG. 21B shows a phylogenetic tree of C10orf54 antibodies for both VH and VL genes, including categorization of paratope bin and flow cluster analysis as described in Example 3. Designation "full-length human" refers to po CC1; "rat" refers to construct CC3; "full-length cyno" refers to construct CC4; "hsIGVmmSTALK" refers to construct CC5; "hsABCmmC10" refers to construct CC7; "mmABChsC10" refers to construct CC8; "hsC10mmLOOP" refers to construct CC9; and "mmC10hsLOOP" refers to construct CC10, as described in Example 3.
Figure 21B:
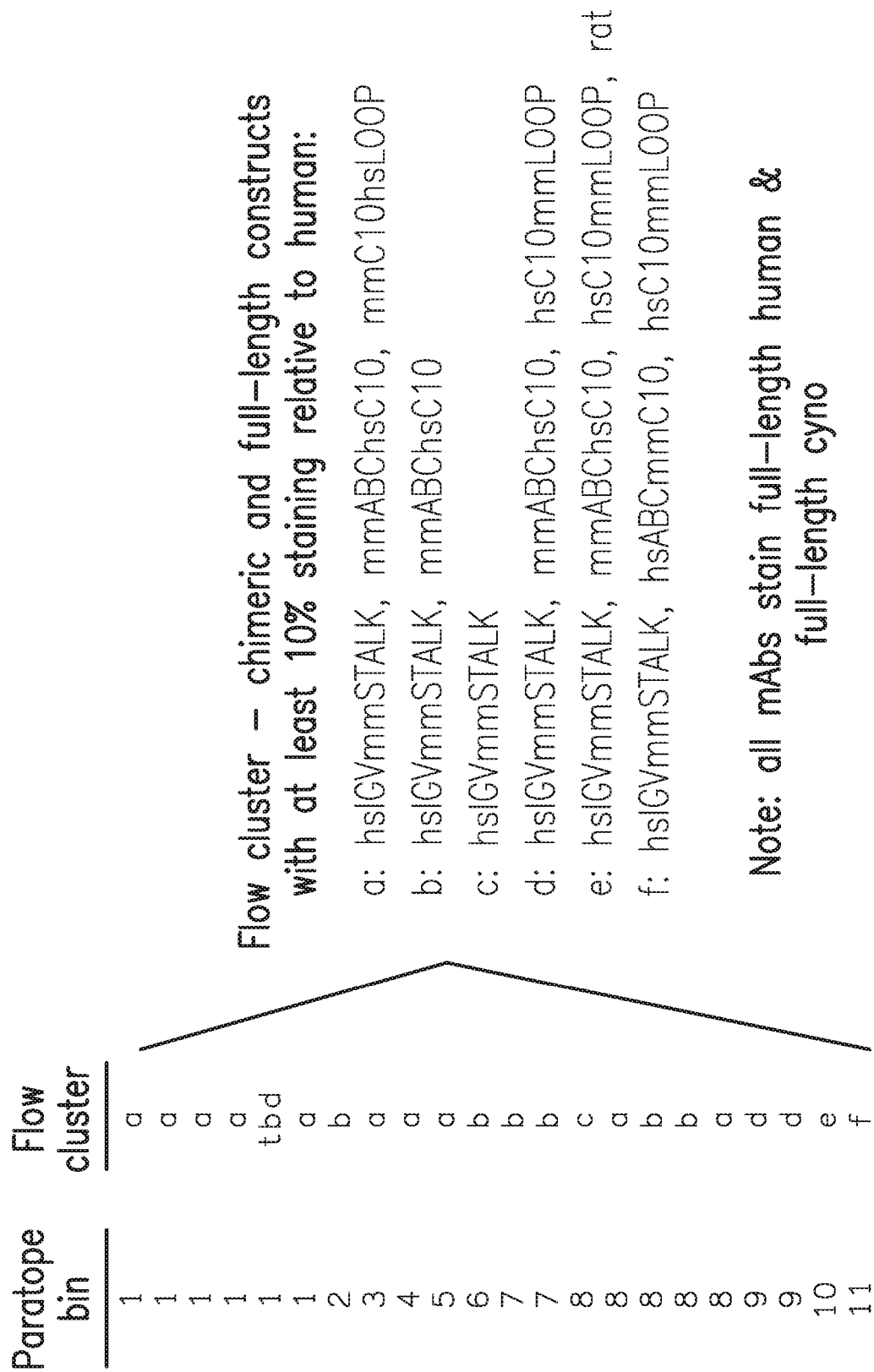
Figure 21B:
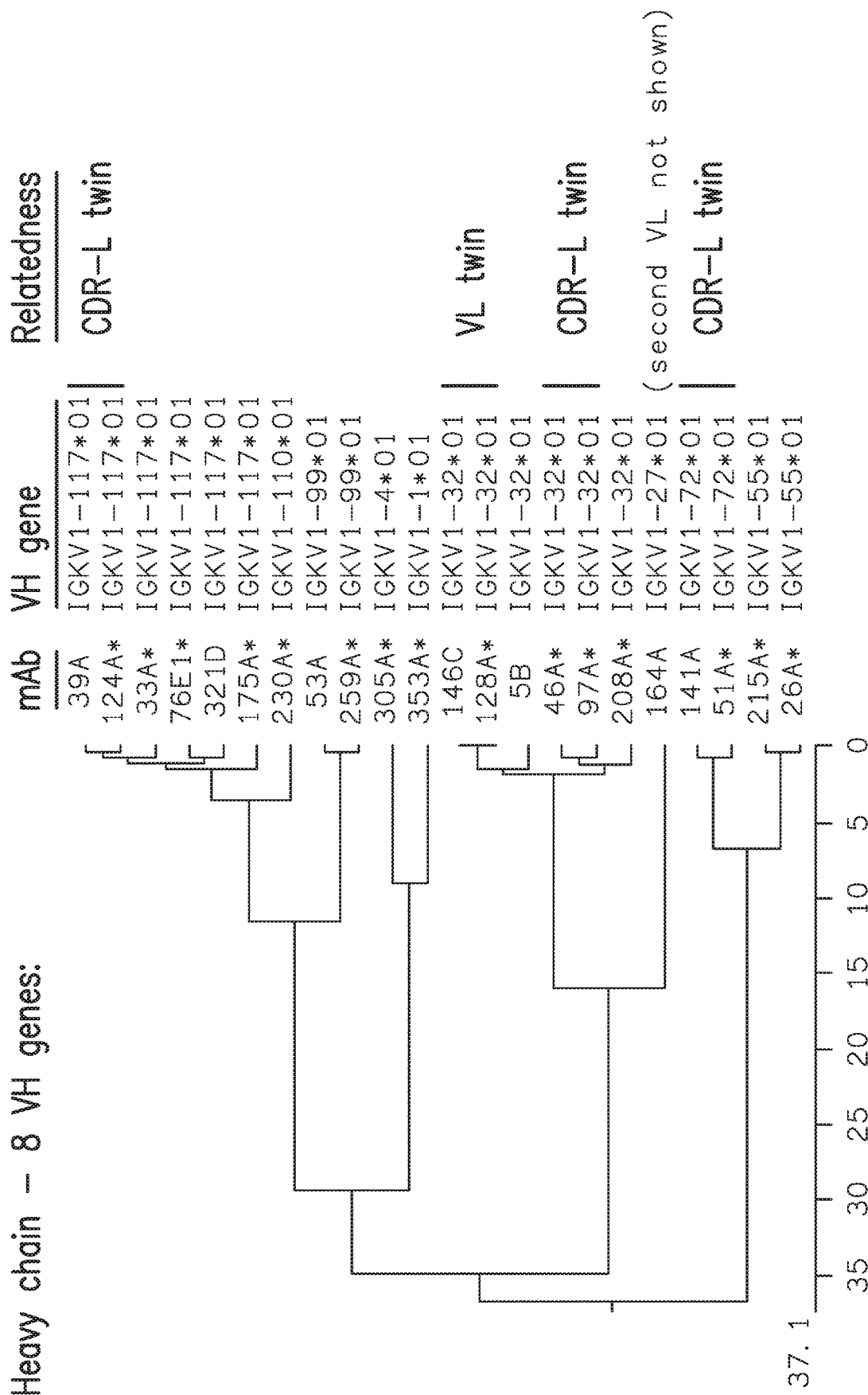

FIG. 15 shows results of treatment with anti-C10orf54 antibodies and ADCs (e.g., unconjugated and MMAF conjugated anti-C10orf54 antibodies) in an animal tumor (e.g., xenograft) model, with C10orf54-expressing and parental sarcoma lines.

Example 8—Preparation and Use of Additional Antibody-Drug Conjugates

Additional antibody-drug conjugates of formula (Ia) or (Ib) of the present disclosure may be prepared as illustrated with formula (Ia) in the following Scheme G, and with formula (Ib) in the following Scheme H for:

Scheme G: ADCs of formula (Ia) of the present disclosure

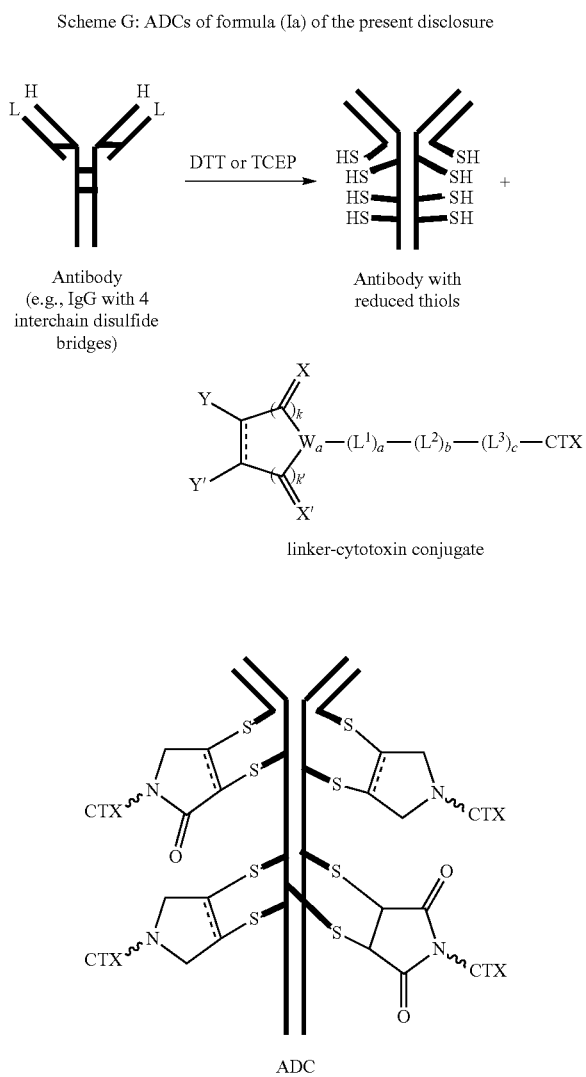

For ease of viewing, the linker-cytotoxin conjugate is represented by a cartoon, where the linker between W$_a$ and CTX is the squiggly line, k and k' are both 0, and Y and Y' are independently any electrophilic leaving group that reacts selectively with thiols.

Scheme H: ADCs of formula (Ib) of the present disclosure

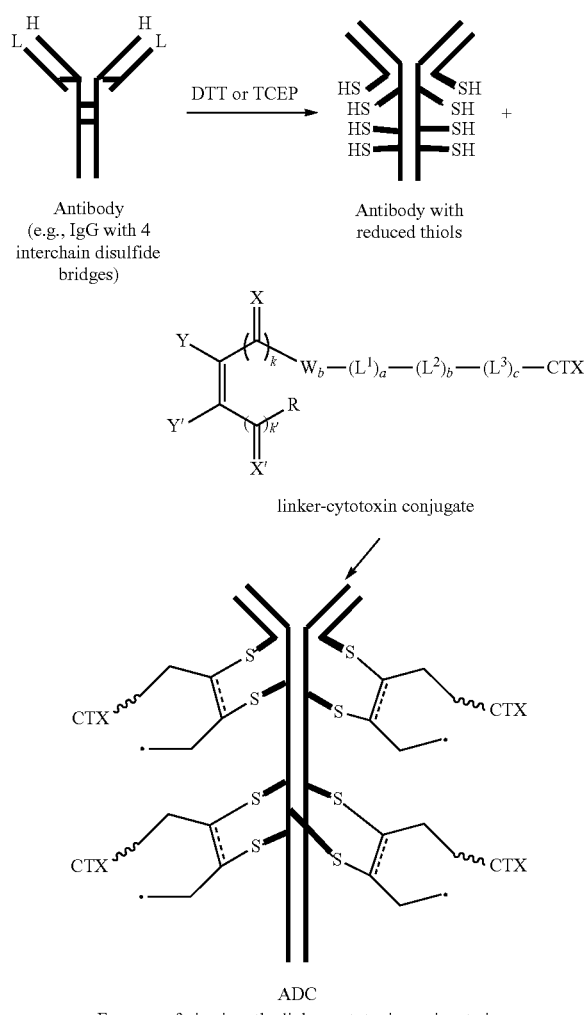

linker-cytotoxin conjugate

ADC
For ease of viewing, the linker-cytotoxin conjugate is represented by a cartoon, where the linker between $W_b$ and CTX is the squiggly line, k and k' are both 0, R is the black dot; and Y and Y' are independently any electrophilic leaving group that reacts selectively with thiols.

Additional antibody-drug conjugates of the present disclosure may be prepared, wherein the antibody-drug conjugates are according to formula (Ic1):

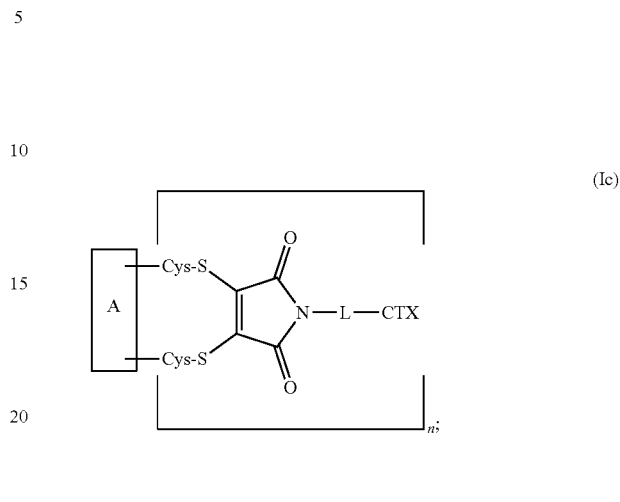

or a pharmaceutically acceptable salt thereof, wherein:

A is an antibody, wherein the antibody is an anti-C10orf54 antibody, optionally a humanized anti-C10orf54 antibody;

the two depicted cysteine residues are from an opened cysteine-cysteine disulfide bond in A;

L is a cleavable or a noncleavable linker;

CTX is cytotoxin bonded to L by an amide bond, a carbamate bond, a disulfide bond, an ether bond, a thioether bond, or an ester bond; and n is an integer of 1 to 4.

For example, the antibody-drug conjugates of formula (Ic1) are prepared where CTX is monomethylauristatin F (MMAF), L is —$(CH_2)_5C(O)$—, and n is 4.

For example, the antibody-drug conjugates of formula (Ic1) are prepared where the antibody-drug conjugate has the following formula:

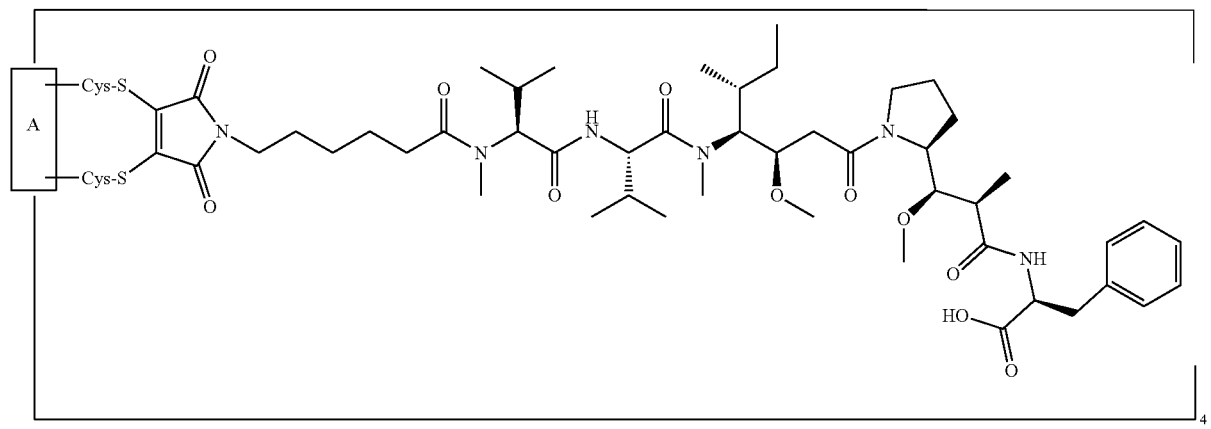

wherein A is an anti-C10orf54 antibody, optionally a humanized anti-C10orf54 antibody, and n is 4.

For example, the antibody-drug conjugates of formula (Ic1) are those where CTX is monomethylauristatin E (MMAE), L is —(CH$_2$)$_5$C(O)-Val-Ala-PAB-O—C(O)—, or —(CH$_2$)$_5$C(O)-Val-Cit-PAB-O—C(O)—, and n is 4.

For example, the antibody-drug conjugates of formula (Ic1) are those which have the following formula:

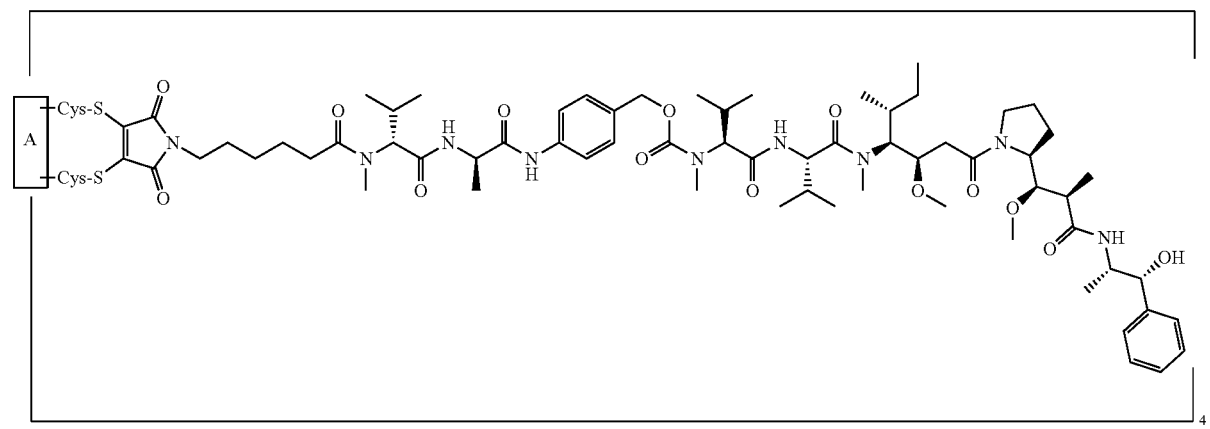

wherein A is an anti-C10orf54 antibody, optionally a humanized anti-C10orf54 antibody, and n is 4.

For example, the antibody-drug conjugates of formula (Ic1) are those where CTX is a pyrrolobenzodiazepine (PDB), L is —(CH$_2$)$_5$C(O)-Val-Ala-PAB-O—C(O)—, or —(CH$_2$)$_5$C(O)-Val-Cit-PAB-O—C(O)—, and n is 4.

For example, the antibody-drug conjugates of formula (Ic1) are those which have one of the following formulas:

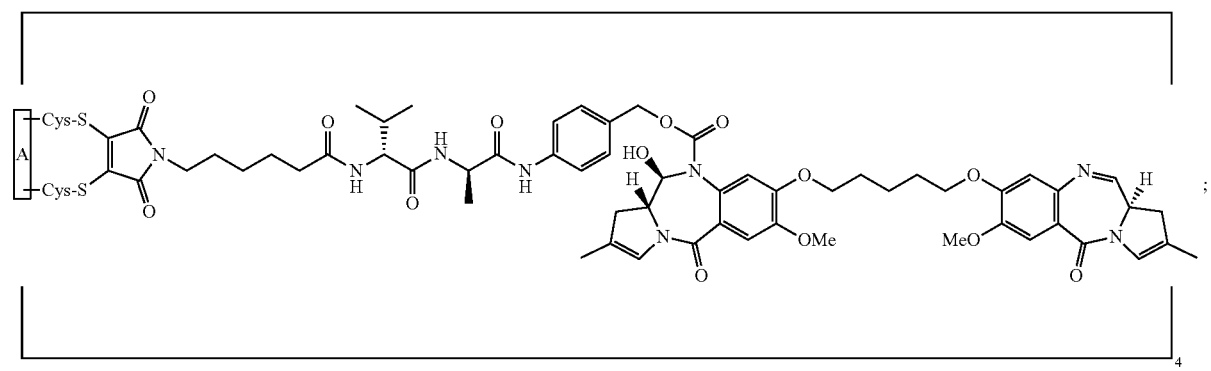

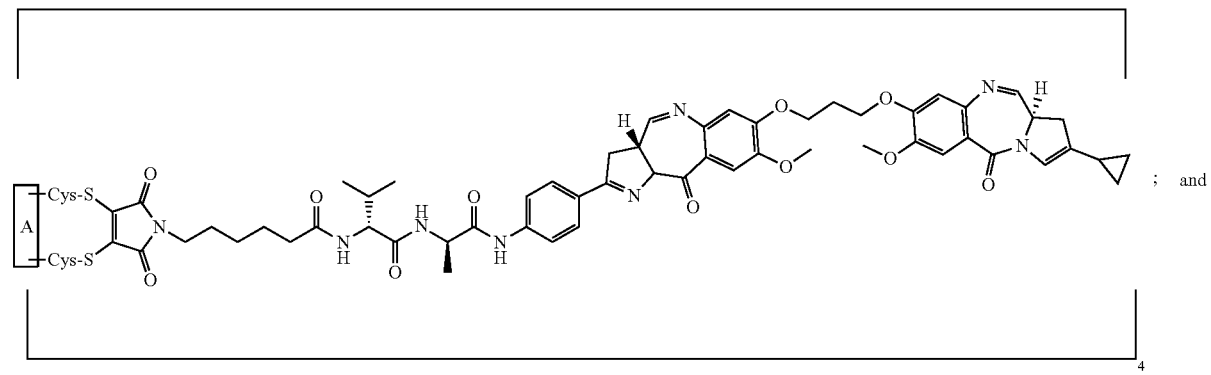

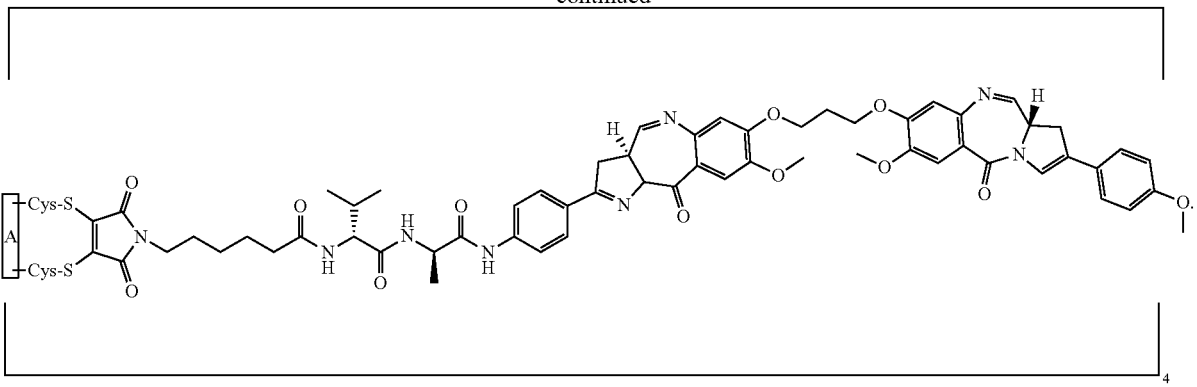

The antibody-drug conjugates of formula (Ic1) are prepared using linker-cytotoxin conjugates of the following formula (IIa):

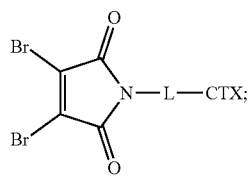

(IIa)

or an enantiomer, diasteriomer, or mixtures thereof;

wherein:
L is a cleavable or noncleavable linker; and
CTX is cytotoxin bonded to L by an amide bond, a carbamate bond, a disulfide bond, an ether bond, a thioether bond, or an ester bond.

For example, the antibody-drug conjugates of formula (Ic1) were prepared with anti-C10orf54 antibodies (e.g., humanized anti-C10orf54 antibodies) using the linker-cytotoxin conjugate of formula (IIa), where CTX is MMAF, and L is —(CH$_2$)$_5$C(O)—.

For example, the antibody-drug conjugates of formula (Ic1) were prepared with anti-C10orf54 antibodies (e.g., humanized anti-C10orf54 antibodies) using the linker-cytotoxin conjugate which has the following structure:

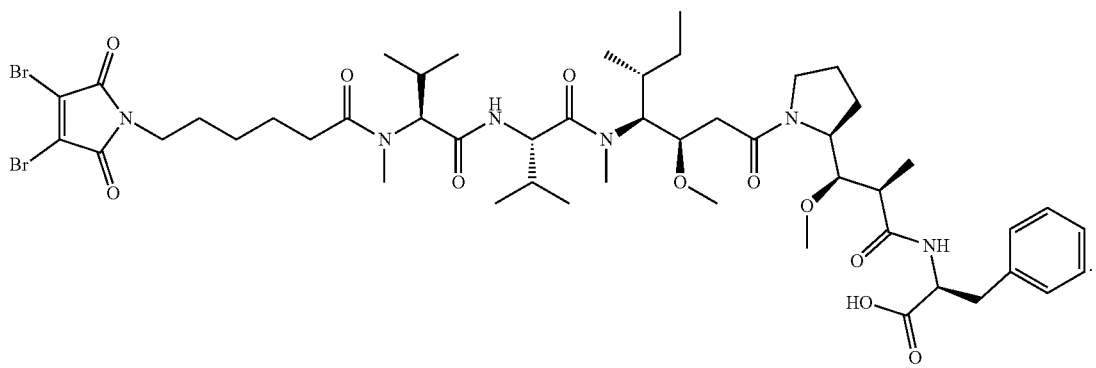 [SMILES: CC[C@@H](C)[C@@H]([C@@H](CC(=O)N1CCC[C@H]1[C@H](OC)[C@@H](C)C(=O)N[C@@H](Cc1ccccc1)C(=O)O)OC)N(C)C(=O)[C@@H](NC(=O)[C@H](C(C)C)N(C)C(=O)CCCCCN1C(=O)C(Br)=C(Br)C1=O)C(C)C]

For example, the antibody-drug conjugates of formula (Ic1) are prepared with anti-16orf54 antibodies (e.g., humanized anti-C10orf54 antibodies) using the linker-cytotoxin conjugate of formula (IIa), where CTX is MMAE, and L is —(CH$_2$)$_5$C(O)-Val-Ala-PAB-O—C(O)—, or —(CH$_2$)$_5$C(O)-Val-Cit-PAB-O—C(O)—.

For example, the antibody-drug conjugates of formula (Ic1) are prepared with anti-C10orf54 antibodies (e.g., humanized anti-C10orf54 antibodies) using the linker-cytotoxin conjugate which has the following structure:

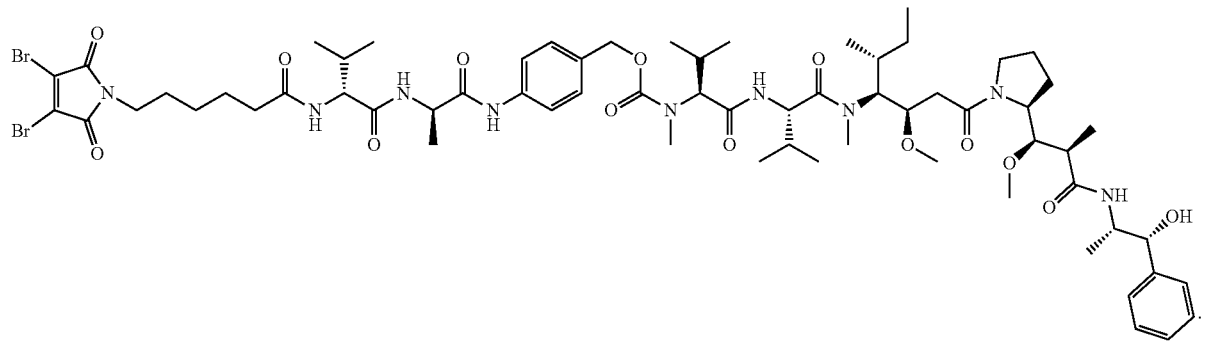 [SMILES: CC[C@@H](C)[C@@H]([C@@H](CC(=O)N1CCC[C@H]1[C@H](OC)[C@@H](C)C(=O)N[C@@H](C)[C@H](O)c1ccccc1)OC)N(C)C(=O)[C@@H](NC(=O)[C@H](C(C)C)N(C)C(=O)OCc1ccc(NC(=O)[C@@H](C)NC(=O)[C@H](NC(=O)CCCCCN2C(=O)C(Br)=C(Br)C2=O)C(C)C)cc1)C(C)C]

For example, the antibody-drug conjugates of formula (Ic1) are prepared with anti-16orf54 antibodies (e.g., humanized anti-C10orf54 antibodies) using the linker-cytotoxin conjugate of formula (IIa), where CTX is PDB, and L is —(CH$_2$)$_5$C(O)-Val-Ala-, —(CH$_2$)$_5$C(O)-Val-Cit-, —(CH$_2$)$_5$C(O)-Val-Ala-PAB-O—C(O)—, or —(CH$_2$)$_5$C(O)-Val-Cit-PAB-O—C(O)—.

For example, the antibody-drug conjugates of formula (Ic1) are prepared with anti-C10orf54 antibodies (e.g., humanized anti-C10orf54 antibodies) using the linker-cytotoxin conjugate which has one of the following structures:

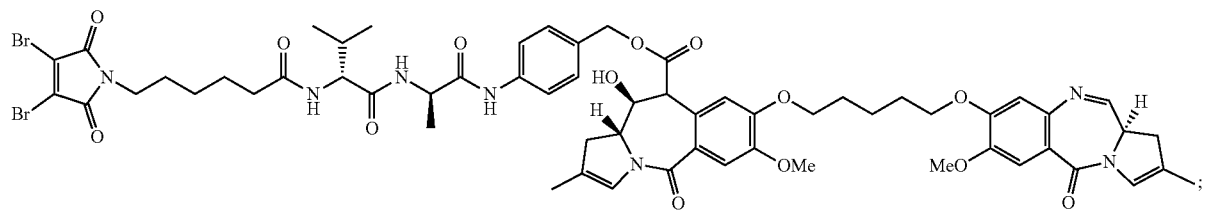

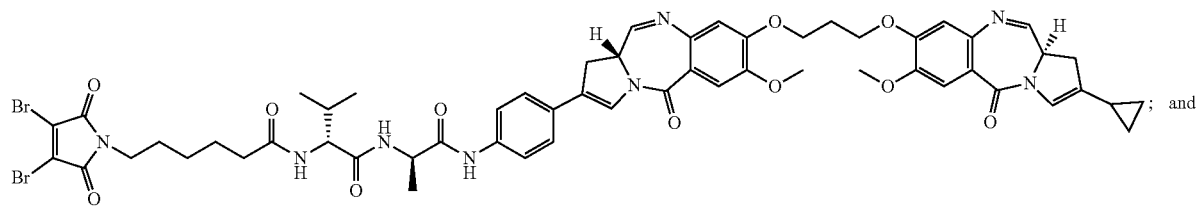

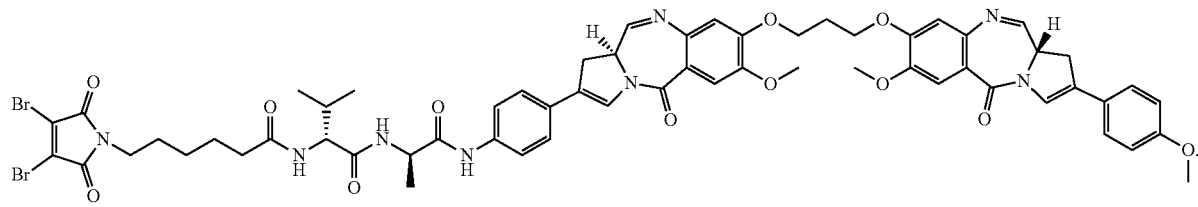

Additional antibody-drug conjugates of the present disclosure may be prepared, wherein the antibody-drug conjugates are according to formula (Ic2):

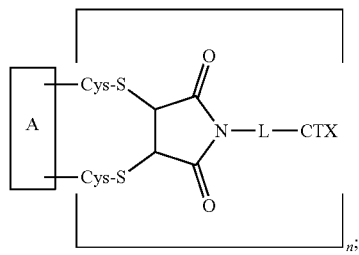

(Ic2)

or a pharmaceutically acceptable salt thereof, wherein:

A is an antibody, wherein the antibody is an anti-C10orf54 antibody, optionally a humanized anti-C10orf54 antibody;

the two depicted cysteine residues are from an opened cysteine-cysteine disulfide bond in A;

L is a cleavable or a noncleavable linker;

CTX is cytotoxin bonded to L by an amide bond, a carbamate bond, a disulfide bond, an ether bond, a thioether bond, or an ester bond; and n is an integer of 1 to 4.

For example, the antibody-drug conjugates of formula (Ic2) are prepared where CTX is monomethylauristatin F (MMAF), L is —$(CH_2)_5C(O)$—, and n is 4.

For example, the antibody-drug conjugates of formula (Ic2) are prepared where the antibody-drug conjugate has the following formula:

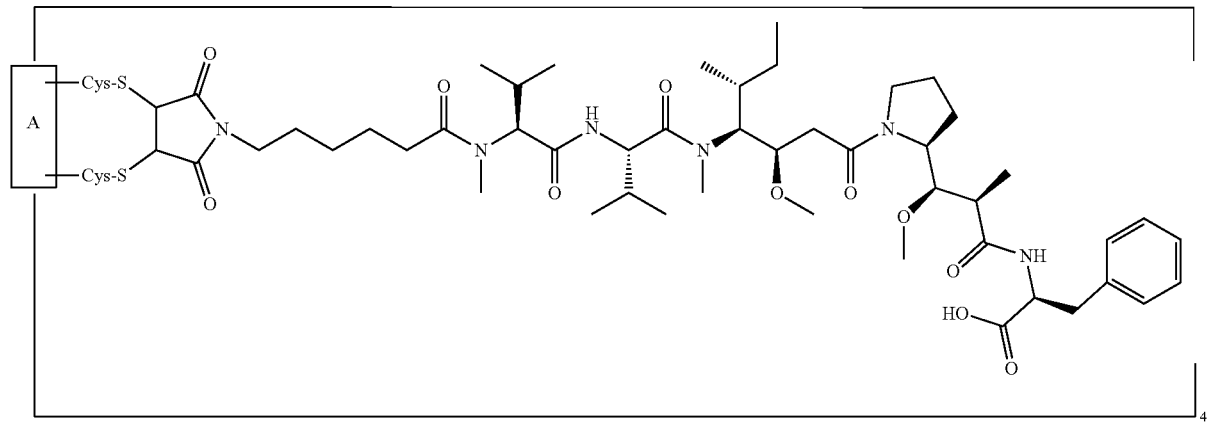

wherein A is an anti-C10orf54 antibody, optionally a humanized anti-C10orf54 antibody, and n is 4.

For example, the antibody-drug conjugates of formula (Ic2) are those where CTX is monomethylauristatin E (MMAE), L is —$(CH_2)_5C(O)$-Val-Ala-PAB-O—C(O)—, or —$(CH_2)_5C(O)$-Val-Cit-PAB-O—C(O)—, and n is 4.

For example, the antibody-drug conjugates of formula (Ic2) are those which have the following formula:

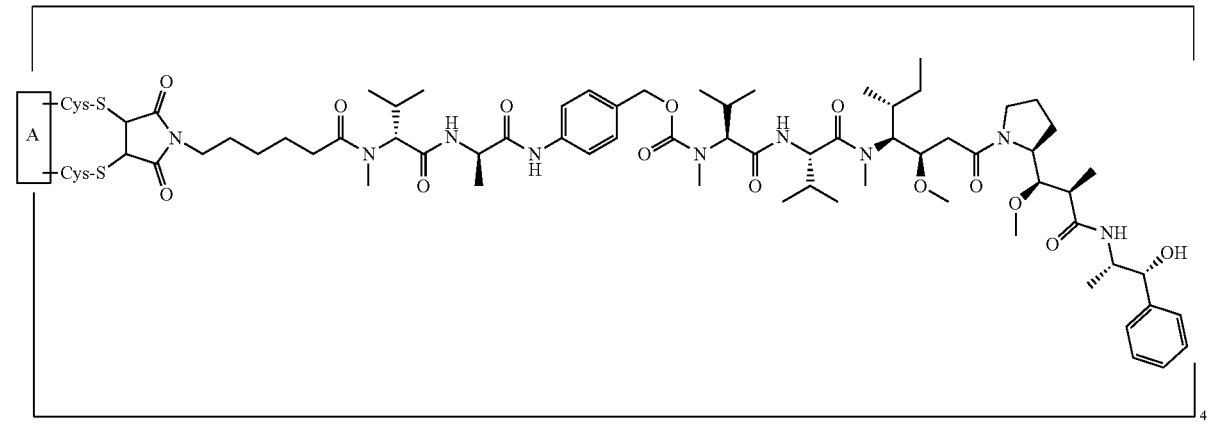

wherein A is an anti-C10orf54 antibody, optionally a humanized anti-C10orf54 antibody, and n is 4.
For example, the antibody-drug conjugates of formula (Ic2) are those where CTX is a pyrrolobenzodiazepine (PDB), L is —(CH$_2$)$_5$C(O)-Val-Ala-PAB-O—C(O)—, or —(CH$_2$)$_5$C(O)-Val-Cit-PAB-O—C(O)—, and n is 4.
For example, the antibody-drug conjugates of formula (Ic2) are those which have one of the following formulas:
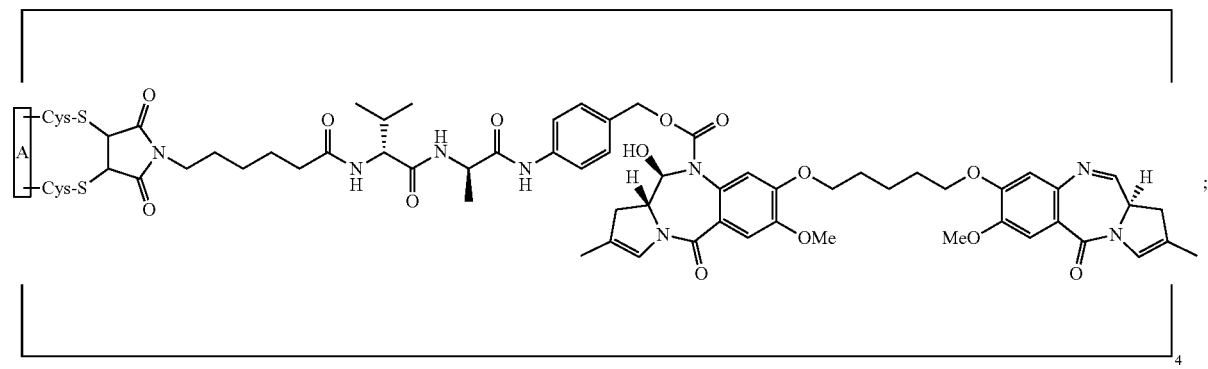
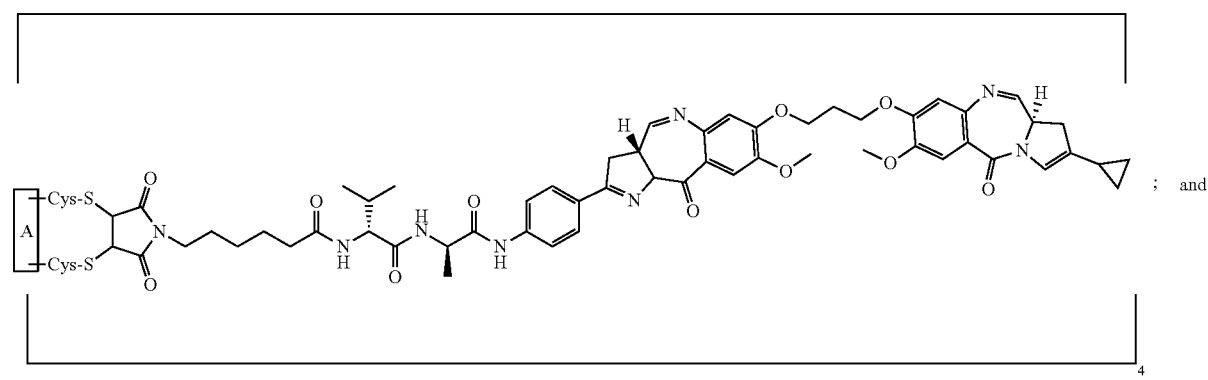
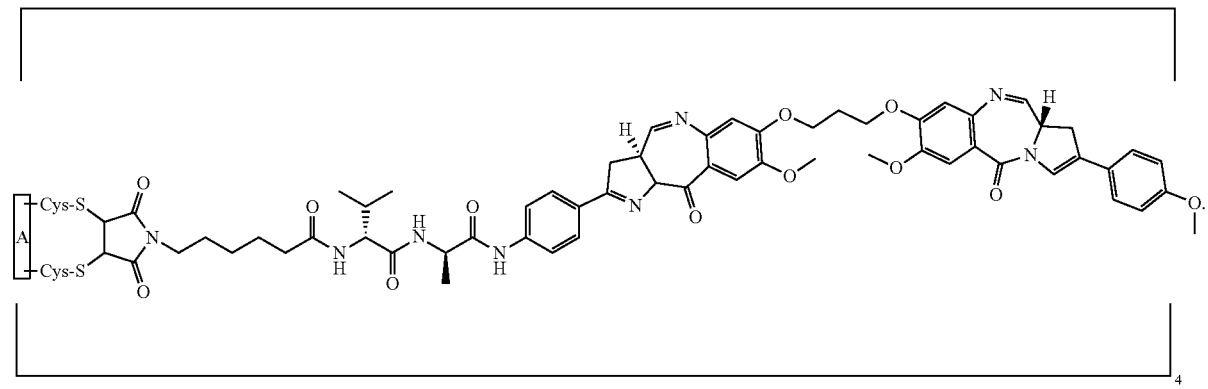

The antibody-drug conjugates of formula (Ic2) are prepared using linker-cytotoxin conjugates of one of the following formulas (IIb) and (IIc):

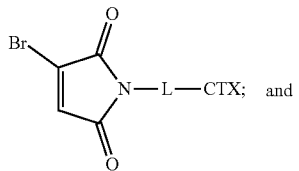

(IIb)

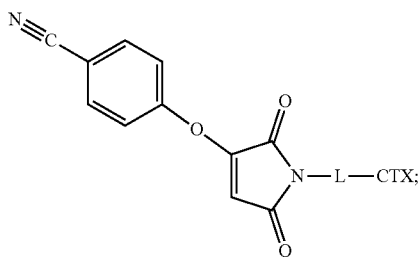

(IIc)

or an enantiomer, diasteriomer, or mixtures thereof;

wherein:

L is a cleavable or noncleavable linker; and

CTX is cytotoxin bonded to L by an amide bond, a carbamate bond, a disulfide bond, an ether bond, a thioether bond, or an ester bond.

For example, the antibody-drug conjugates of formula (Ic2) are prepared with anti C10orf54 antibodies (e.g., humanized anti-C10orf54 antibodies) using the linker-cytotoxin conjugate of formula (IIb) or (IIc), where CTX is MMAF, and L is —$(CH_2)_5C(O)$—.

For example, the antibody-drug conjugates of formula (Ic2) are prepared with anti-C10orf54 antibodies (e.g., humanized anti-C10orf54 antibodies) using the linker-cytotoxin conjugate which has one of the following structures:

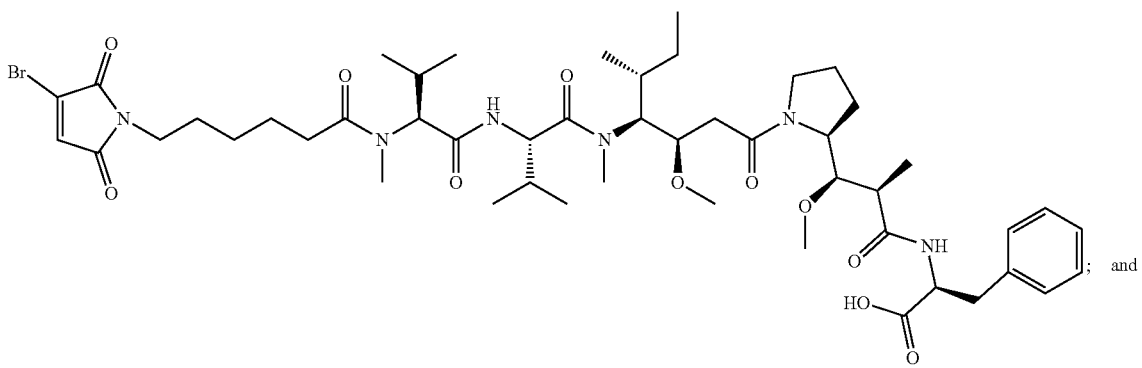

; and

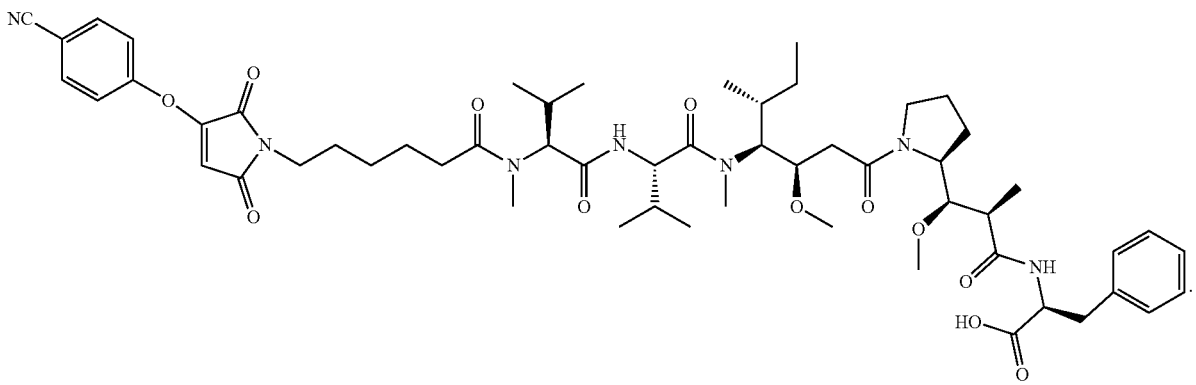

.

For example, the antibody-drug conjugates of formula (Ic2) are prepared with anti-16orf54 antibodies (e.g., humanized anti-C10orf54 antibodies) using the linker-cytotoxin conjugate of formula (IIb) or (IIc), where CTX is MMAE, and L is —$(CH_2)_5C(O)$—Val-Ala-PAB-O—C(O)—, or —$(CH_2)_5C(O)$-Val-Cit-PAB-O—C(O)—.

For example, the antibody-drug conjugates of formula (Ic2) are prepared with anti-C10orf54 antibodies (e.g., humanized anti-C10orf54 antibodies) using the linker-cytotoxin conjugate which has one of the following structures:

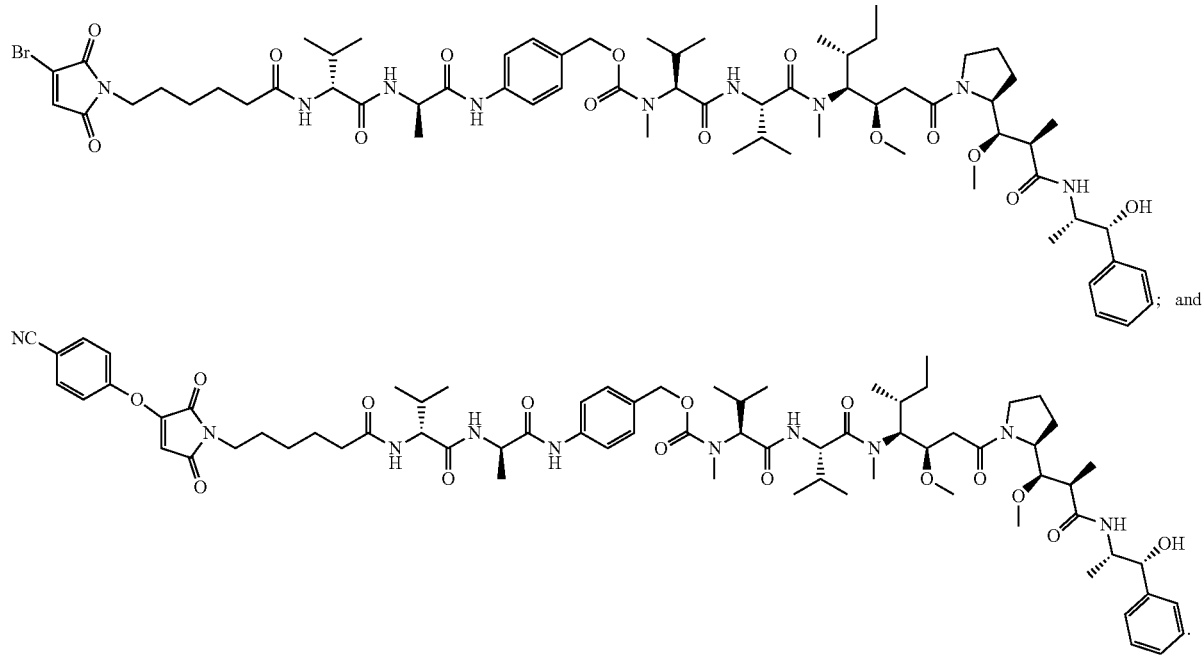

For example, the antibody-drug conjugates of formula (Ic2) are prepared with anti-16orf54 antibodies (e.g., humanized anti-C10orf54 antibodies) using the linker-cytotoxin conjugate of formula (IIb) or (IIc), where CTX is PDB, and L is —(CH$_2$)$_5$C(O)-Val-Ala-, —(CH$_2$)$_5$C(O)-Val-Cit-, —(CH$_2$)$_5$C(O)-Val-Ala-PAB-O—C(O)—, or (CH$_2$)$_5$C(O)-Val-Cit-PAB-O—C(O)—.

For example, the antibody-drug conjugates of formula (Ic2) are prepared with anti-C10orf54 antibodies (e.g., humanized anti-C10orf54 antibodies) using the linker-cytotoxin conjugate which has one of the following structures:

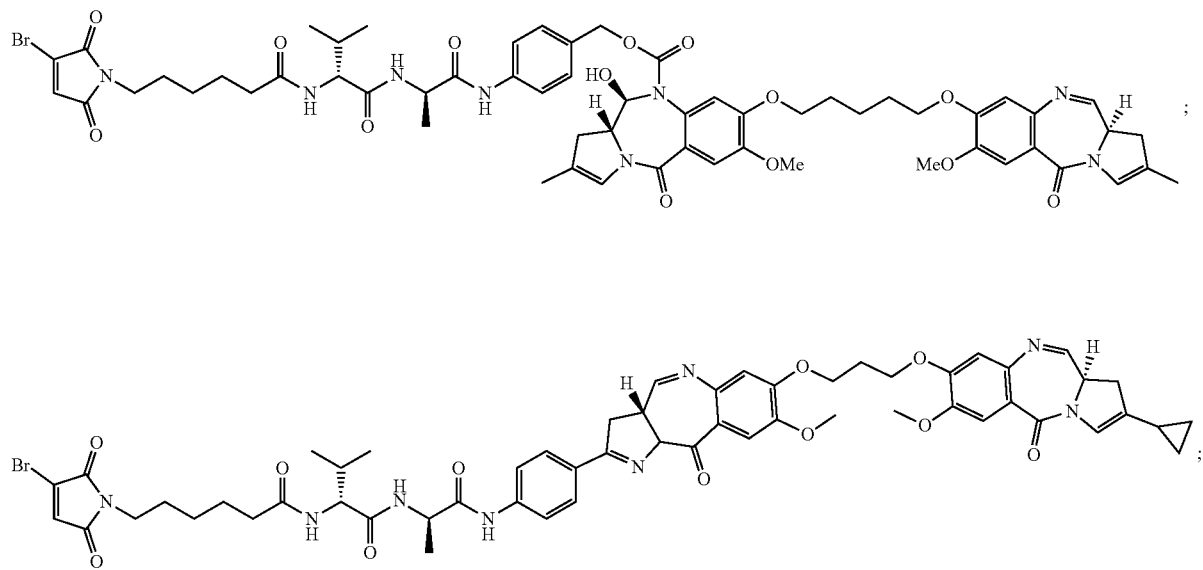

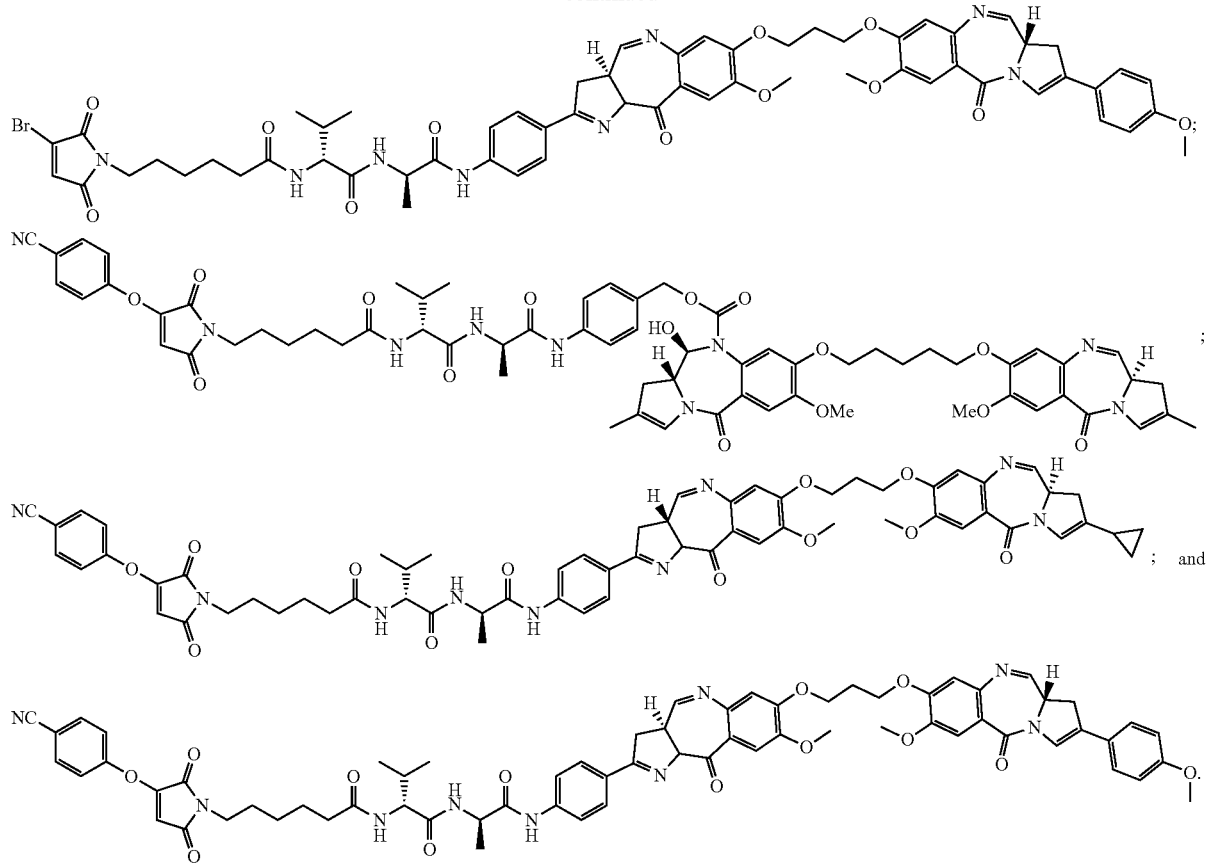

Antibody-drug conjugates, as described in this example and herein, are prepared wherein one or more interchain disulfide bonds of the antibody (e.g., four interchain disulfide bonds as depicted in exemplary Schemes F and G above) are conjugated. Antibody-drug conjugates, wherein one or more of the intrachain disulfide bonds of the antibody are conjugated, as described herein, have a preferred antibody-to-drug ratio of four.

Cell viability experiments were performed using human AML cell lines such as OCI/AML3, PL21 and P31/FUJ. For the primary ADC assays, myeloid cell lines were routinely passaged in RPMI or MEM media (LifeTech) supplemented with 10-20% fetal calf serum (LifeTech). To assay toxicity, cells were plated in 384-well plates (Greiner) at 3,000 cells per well in 50 µL of media.

For the primary ADC assays, DBM(C6)MMAF-conjugated anti-C10orf54 antibodies are serially-diluted from 100-300 nM in RPMI and added to appropriate wells in duplicate using an iPipette liquid handler (Apricot Designs). Cell plates are then incubated for three days, followed by lysis in Cell-Titer Glo assay reagent (Promega).

For primary ADC assays, luminescence is quantified on a Synergy HT plate reader (BioTek) and graphed. IC50s are calculated by fitting to a four-parameter sigmoidal fit (GraphPad). Results of exemplary primary ADC assays using three myeloid cell lines are shown as IC50 (nM) values in Table 41. For example, the ADCs represented in Table 41 were generated by conjugating the humanized variants of the antibodies to the DBM-(C6)-MMAF linker-toxin as described in this Example 8. The results indicate that the OCI/AML3 cell line and P31/FUJ were both sensitive to anti C10orf54 ADCs, while the PL21 cell line was less sensitive

TABLE 41

| Antibody* | IC50 (nM) | | |
|---|---|---|---|
| | OCI/AML3 | P31FUJ | PL21 |
| C1.18 DBM(C6)MMAF | >100 | >100 | >100 |
| 146C:DBM(C6):MMAF | 58.62 | <.001 | >100 |
| 164A:DBM(C6):MMAF | 0.30 | <.001 | 62.86 |
| 208A:DBM(C6):MMAF | 0.31 | <.001 | >100 |
| 215A:DBM(C6):MMAF | 0.43 | <.001 | >100 |
| 230A:DBM(C6):MMAF | 3.06 | <.001 | >100 |
| 259A:DBM(C6):MMAF | 1.56 | <.001 | >100 |
| 305A:DBM(C6):MMAF | 0.81 | <.001 | >100 |
| 353A:DBM(C6):MMAF | 0.51 | <.001 | >100 |
| 53A:DBM(C6):MMAF | 0.34 | 0.16 | 4.97 |
| 5B:DBM(C6):MMAF | 1.01 | <.001 | >100 |
| 175A:DBM(C6):MMAF | 0.16 | <.001 | 7.83 |
| 76E1:DBM(C6):MMAF | 0.02 | 0.08 | 0.11 |

The embodiments of the present disclosure described above are intended to be merely exemplary, and those skilled in the art will recognize, or be able to ascertain using no more than routine experimentation, numerous equivalents to the specific procedures described herein. All such equivalents are considered to be within the scope of the present disclosure and are covered by the following claims. Furthermore, as used in this specification and claims, the singular forms "a," "an" and "the" include plural forms unless the content clearly dictates otherwise. Thus, for example, reference to "an antibody" includes a mixture of two or more such antibodies, and the like. Additionally, ordinarily skilled artisans will recognize that operational sequences must be set forth in some specific order for the purpose of explanation and claiming, but the present disclosure contemplates various changes beyond such specific order.

Example 9—Functional Assays

In order to identify optimal conditions of cultivation and activation of naïve T-cells to the extent that this activation can be reversed by administration of anti-C10orf54 antibodies, the following experiments were conducted. Once optimal conditions are identified, they can be used in further anti-C10orf54 antibody screening, such as those described herein. Optimal concentrations of anti-CD3 antibodies, anti-CD28 antibodies, C10orf54-Fc, and T-cells have been determined.

CellTiter-Glo, a luminescent cell viability assay, was used to determine viability of T-cells cultivated at various conditions. T-cell activation was achieved by precoating of plates with anti-CD3 antibodies followed by co-stimulation with anti-CD28 antibodies in solution. The starting conditions were based on the data presented by Wang et al., Biofunctions of three new B7 family members, https://www.mdsystems.com (Dec. 10, 2015).

T-cell concentration appeared to be important for anti-CD3/anti-CD28-dependent stimulation of T-cells. Only the highest amount tested, 50,000 cells per well of 384-well plate, demonstrated such dependence and was used for all further steps. Minimal anti-CD3 antibody concentration, at which activation close to maximal level was achieved, was 5 ug/ml. At the defined concentration of anti-CD3 antibody, a concentration-dependent C10orf54-Fc impact on T-cell proliferation was observed. With a stronger activation attained by CD2/CD3/CD28 magnetic beads, the effect was not observed.

Minimal anti-CD28 antibody concentration, at which T-cell proliferation close to maximal level was achieved, was shown to be about 3-4 ug/ml. Concentration-dependent impact of C10orf54-Fc on T-cell proliferation was observed within all the tested range of anti-CD28 antibody. Thus, a 3.2 ug/ml point has been chosen for the further steps.

Figure 30A:
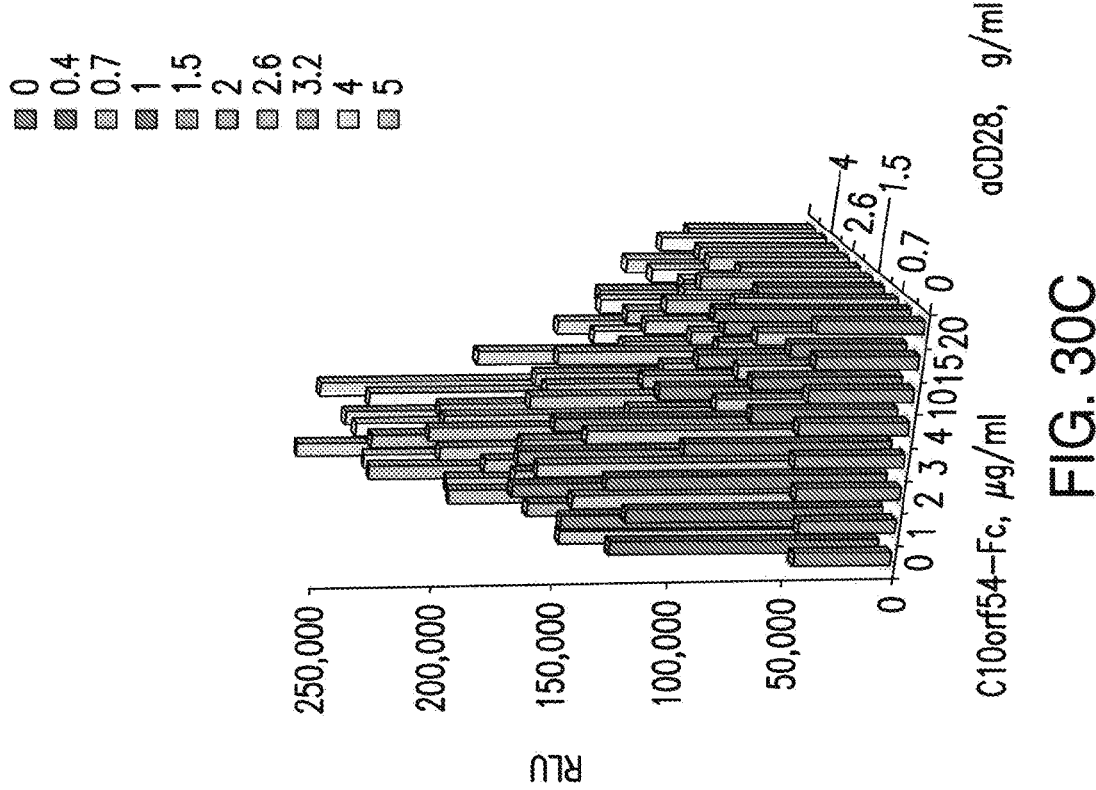
FIGS. 30A to 30C show a comparison of naïve and pan T cell populations. 50,000 Tcells per well were grown in plates precoated with 5 ug/ml anti-CD3 antibody and various concentrations of C10orf54-Fc. Cells were co-stimulated further with various concentrations of anti-CD28 antibody (no anti-CD3 antibody was added to control wells (0 μg/ml αCD28). Values are the average of RLU/well (n=4).
Figure 30B:
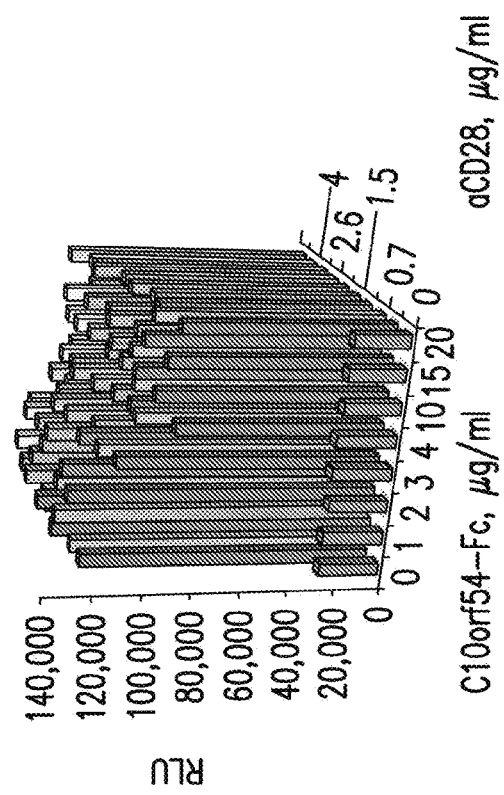
Figure 30C:
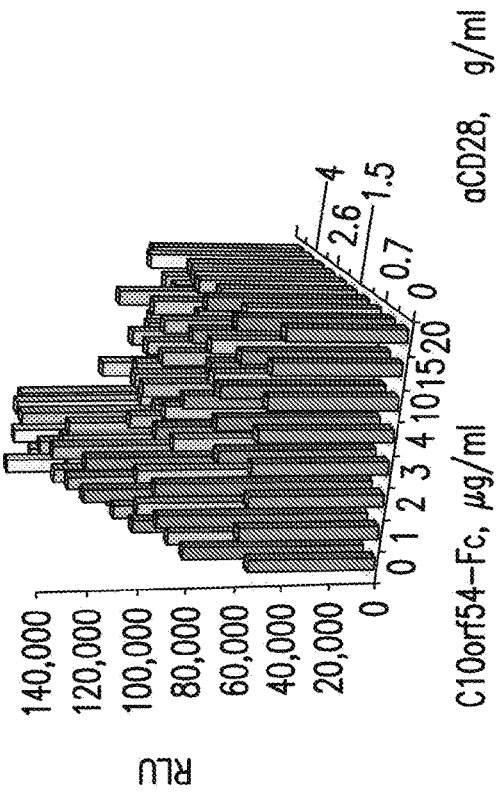

Pan T-cells behaved similarly to naïve T-cells. However, naïve T-cells were more sensitive to C10orf54-Fc inhibition than pan T-cells (FIGS. 30A-30C).

In summary, based on the above analysis, the optimized conditions for cultivation and activation of naïve T-cells are 5 ug/ml of anti-CD3 antibodies and 3.2 ug/ml of anti-CD28 antibodies. The moderate level of activation made it possible to reverse this activation by C10orf54-Fc administration, making this assay helpful for assessing anti-C10orf54 antibodies.

Additional in vitro assays were conducted as described below to determine whether anti-C10orf54 antibodies enhanced T-cell stimulation.

Anti-C10orf54 antibodies described herein were immobilized on a plate at varying concentrations. Naïve T-cells were stimulated by the addition of soluble anti-CD28 antibodies at a concentration of 5 µg/ml and contacting the naïve T-cells to immobilized anti-CD3 antibodies at a concentration of 3.2 µg/ml on the same plate as the anti-C10orf54 antibodies. Enhancement of T-cell stimulation was monitored by IL-2 secretion, IFN-γ secretion and incorporation of $^3$H-thymidine (an indicator of cell proliferation).

The effects of the anti-C10orf54 antibodies on T-cell stimulation are summarized in Table 42 below.

TABLE 42

| mAb | KD [nM] | IL-2 [% of Mean] | IFN-γ [% of Mean] | $^3$H-Thymidine [% of Mean] | Paratope |
| --- | --- | --- | --- | --- | --- |
| 259A | 0.266 | 60 | 112 | 80 | 7 |
| 53A | 0.321 | 58 | 72 | 97 | 7 |
| 128A | 0.635 | 119 | 113 | 80 | 1 |
| 26A | 0.677 | 274 | 208 | 109 | 3 |
| 5B | 0.974 | 71 | 91 | 90 | 1 |
| 230A | 1.05 | 105 | 75 | 104 | 5 |
| 141A | 1.27 | 116 | 108 | 119 | 9 |
| 215A | 1.52 | 70 | 41 | 101 | 2 |
| 51A | 1.52 | 97 | 82 | 124 | 9 |
| 46A | 1.88 | 116 | 99 | 102 | 1 |
| 97A | 1.99 | 95 | 121 | 92 | 1 |
| 208A | 2.48 | 84 | 77 | 97 | 1 |
| 353A | 2.9 | 47 | 110 | 116 | 10 |
| 124A | 3.61 | 169 | 122 | 95 | 8 |
| 39A | 5.79 | 89 | 89 | 110 | 8 |
| 33A | 6.61 | 126 | 125 | 122 | 8 |
| 321D | 7.26 | 55 | 85 | 104 | 8 |
| 76E1 | 10.1 | 173 | 197 | 99 | 6 |
| 305A* | 20.8 | 10 | 35 | 61 | 11 |
| 175A* | 108 | 9 | 40 | 82 | 8 |

*Low affinity antibodies; 20 nM = 3 µg.

Still further, in vitro assays were conducted as described below to determine whether anti-C10orf54 antibodies induced T-cell proliferation.

The C10orf54-Fc construct, as described above, was immobilized on a plate at varying concentrations. As a positive control, an IgG-Fc construct was also immobilized on a separate plate. Naïve T-cells were stimulated by the addition of soluble anti-CD28 antibodies at a concentration of 5 µg/ml and contacting the naïve T-cells to immobilized anti-CD3 antibodies at a concentration of 3.2 µg/ml on the same plate as either the C10orf54-Fc construct or the IgG-Fc control. Additionally, soluble anti-C10orf54 antibodies (26A or 175A described herein) were added to further enhance T-cell stimulation. Enhancement of T-cell stimulation was monitored by IL-2 secretion, IFN-γ secretion and incorporation of $^3$H-thymidine (an indicator of cell proliferation).

Figure 29:
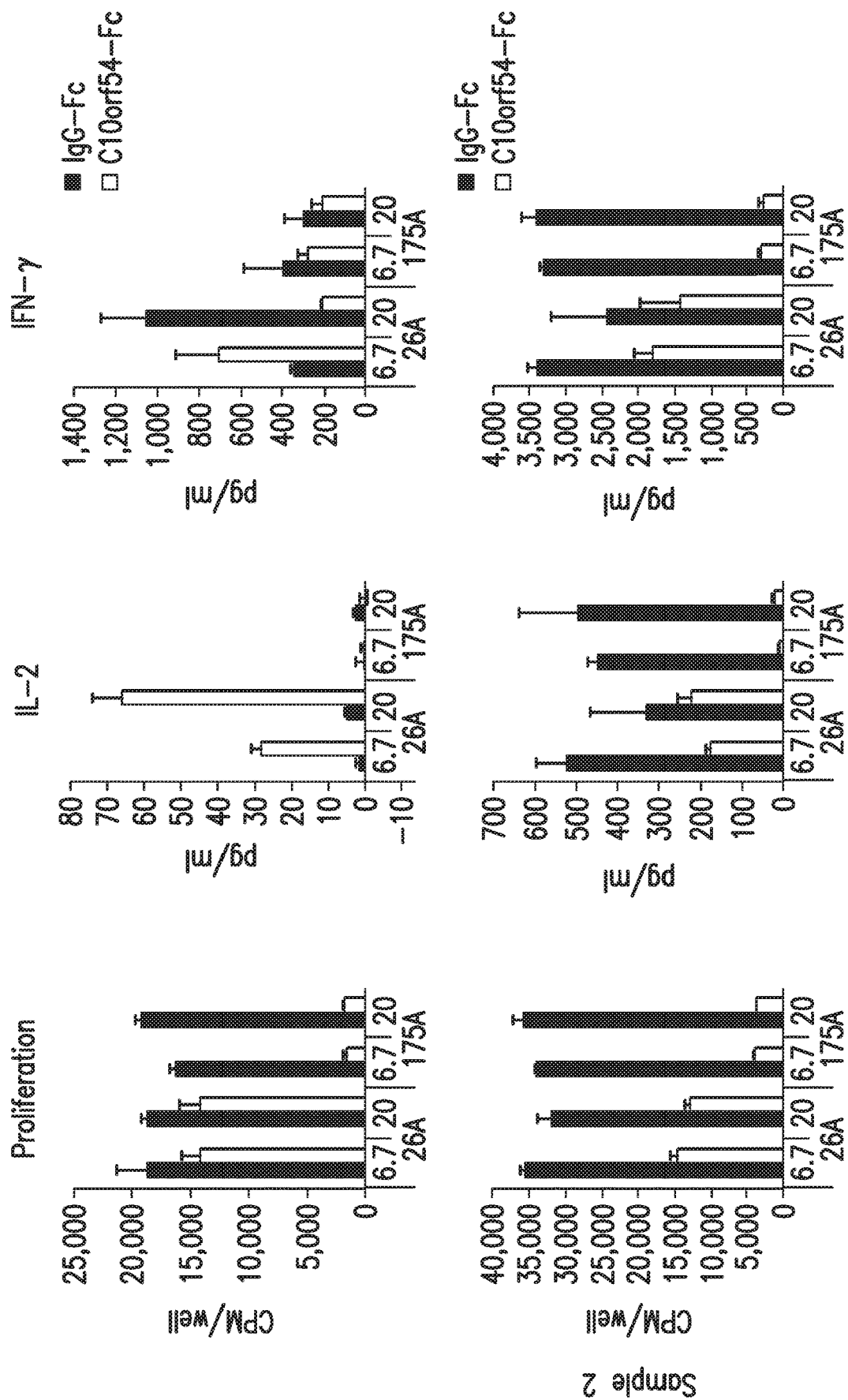
FIG. 29 shows bar graphs of the ability of anti-C10orf54 antibodies to attenuate C10orf54-mediated suppression of naive T-cell proliferation and cytokine secretion.

The anti-C10orf54 antibody 26A attenuated C10orf54-mediated suppression of naïve T-cell proliferation, as well as secretion of IL-2 and IFN-γ. These results are shown in FIG. 29.

Still further in vitro assays were conducted as described below to determine whether C10orf54 inhibits T-cell stimulation in naïve T-cells, CD4+ T-cells and CD8+ T-cells.

The C10orf54-Fc construct, as described above, was immobilized on a plate at varying concentrations. As a positive control, an IgG-Fc construct was also immobilized on a separate plate. The T-cells were stimulated by the addition of soluble anti-CD28 antibodies at a concentration of 5 µg/ml and contacting the T-cells to immobilized anti-CD3 antibodies at a concentration of 3.2 µg/ml on the same plate as either the C10orf54-Fc construct or the IgG-Fc control. Inhibition of T-cell stimulation was monitored by incorporation of $^3$H-thymidine (an indicator of cell proliferation).

Figure 28:
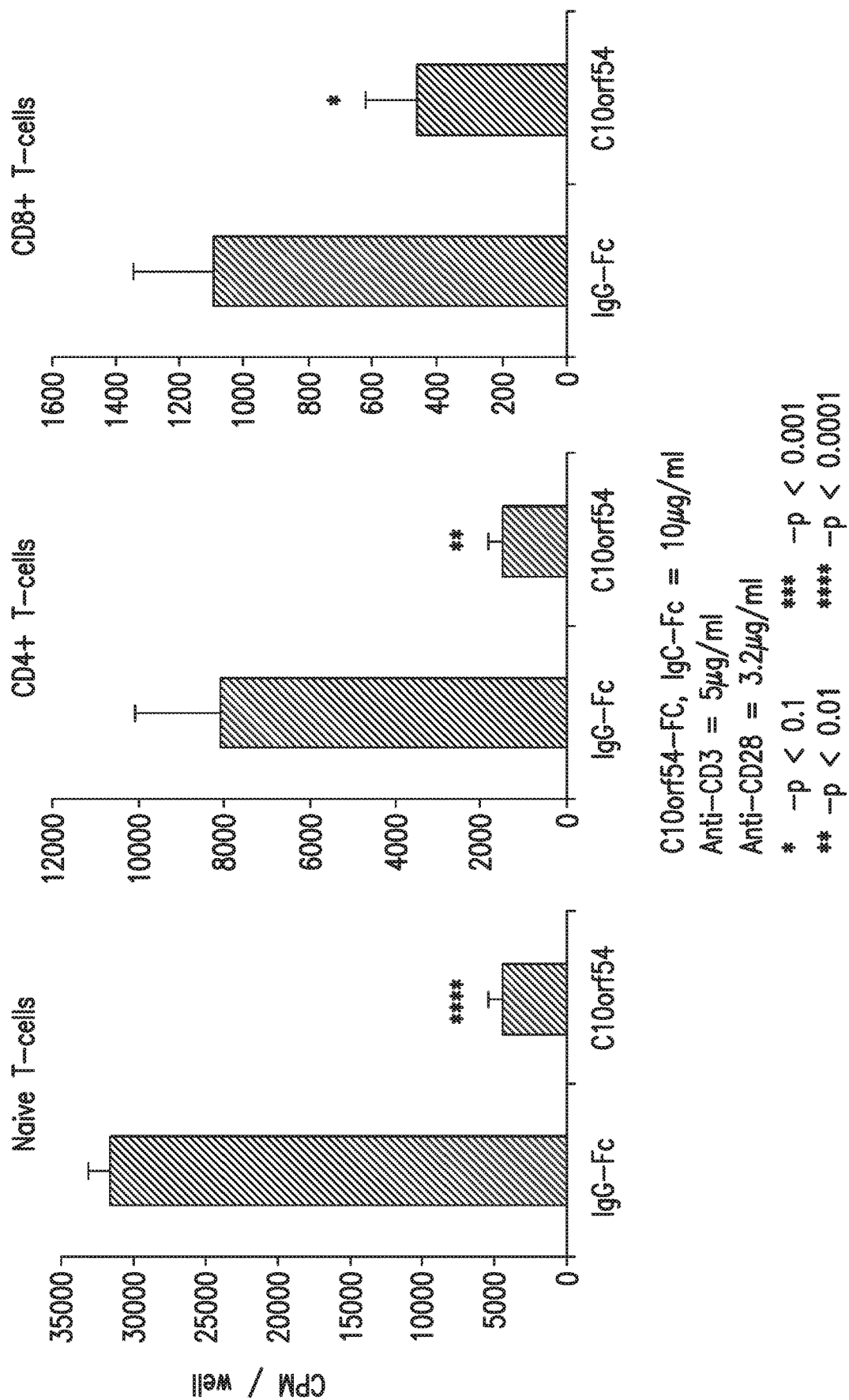
FIG. 28 shows bar graphs of T-cell proliferation being inhibited by exposure to a C10orf54-Fc construct. Incorporation of $^3$H-thymidine is depicted.

The immobilized C10orf54-Fc construct at a concentration of 10 µg/ml inhibited the anti-CD3/anti-CD28-stimulated naïve T-cells, as well as inhibited CD4+ or CD8+ T-cells, as measured by incorporation of $^3$H-thymidine. These results are shown in FIG. 28. In additional assays, anti-C10orf54 antibodies, such as 26A, are added to the assay to attenuate the C10orf54-mediated suppression of naïve T-cells, CD4+ T-cells or CD8+ T-cells.

The contents of all references described herein are hereby incorporated by reference. Other embodiments are within the following claims.

SEQUENCE LISTING (1940 sequences)

SEQ ID NO: 1 - protein, 118 aa, Mus musculus
  Murine antibody 76E1 VH domain
EVQLLQSGPELEKPGASVKISCKASGYSFTGYNMNWVKQSNGKSLEWIGNIDPYYDYTSYNLKFKDKATLTVDKSSSTAYMQLKSLTSEDSAVYYCATSTMITPFDYWGQGTTLTVSS

SEQ ID NO: 2 - protein, 121 aa, Mus musculus
  Murine antibody 141A VH domain
QVQLQQSGAELMKPGASVKISCKATGYTFSRYWIEWVKQRPGHGLEWIGEILPGSGSTNYNEKFKGKATFTADTSSNTAYMQLSSLTSEDSAVYYCAGEEVYDGYPWFGYWGQGTLVTVSA

SEQ ID NO: 3 - protein, 119 aa, Mus musculus
  Murine antibody 175A VH domain
QVQLQQSGAELMKPGASVKISCKATGYTFSTHWIEWVKQRPGHGLEWIGEILPGSGSTSYNEKFKGKATFTADTSSNTAYMQLSSLTSEDSAVYYCARWLLYYYAMDYWGQGTSVTVSS

SEQ ID NO: 4 - protein, 112 aa, Mus musculus
  Murine antibody 76E1 VL domain
DVLMTQTPLSLPVSLGDQASISCRSSQSIVHSNGNTYLEWYLQKPGQSPKLLIYKVSNRFSGVPDRFSGSGSGTDFTLKINRVEAEDLGVYYCFQGSHVPWTFGGGTKLEIK

SEQ ID NO: 5 - protein, 106 aa, Mus musculus
  Murine antibody 141A VL domain
QIVLSQSPAILSASPGEKVTMTCRASSSLSYMHWYQQKPGSSPKPWIYATSNLASGVPARFSGSGSGTSYSLTISRVEAEDAATYYCQQWSSNPYTFGGGTKLEIK

SEQ ID NO: 6 - protein, 112 aa, Mus musculus
  Murine antibody 175A VH domain
DVLMTQTPLSLPVSLGDQASISCRSSQSIVHSNGNTYLEWYLQKPGQSPKLLIYKLSNRFSGVPDRFSGSGSGTDFTLKISRVEAEDLGVYYCFQGSHFPYTFGGGTKLEIK

SEQ ID NO: 7 - protein, 98 aa, Homo sapiens
  Human germline Immunoglobulin (IMGT IGHV1-18) Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAR

SEQ ID NO: 8 - protein, 98 aa, Homo sapiens
  Human germline Immunoglobulin (IMGT IGHV3-48) Heavy chain
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAR

SEQ ID NO: 9 - protein, 100 aa, Homo sapiens
  Human germline Immunoglobulin (IMGT IGKV2-28) light chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTP

SEQ ID NO: 10 - protein, 95 aa, Homo sapiens
  Human germline Immunoglobulin (IMGT IGKV1-39) light chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 11 - protein, 96 aa, Homo sapiens
  Human germline Immunoglobulin (IMGT IGKV3-20) light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSP

SEQ ID NO: 12 - protein, 118 aa, Artificial Sequence
  Description of Artificial Sequence: Synthetic humanized antibody VH domain
QVQLVQSGAEVKKPGASVKVSCKASGYSFTGYNMNWVRQAPGQGLEWMGNIDPYYDYTSYNLKFKDRVTMTTDTSTSTAYMELRSLRSDDTAVYYCARSTMITPFDYWGQGTLVTVSS

SEQ ID NO: 13 - protein, 118 aa, Artificial Sequence
  Description of Artificial Sequence: Synthetic humanized antibody VH domain
QVQLVQSGAEVKKPGASVKVSCKASGYSFTGYNMNWVRQAPGQGLEWMGNIDPYYDYTSYAQKLQGRVTMTTDTSTSTAYMELRSLRSDDTAVYYCARSTMITPFDYWGQGTLVTVSS

SEQ ID NO: 14 - protein, 118 aa, Artificial Sequence
  Description of Artificial Sequence: Synthetic humanized antibody VH domain
EVQLVESGGGLVQPGGSLRLSCAASGYSFTGYNMNWVRQAPGKGLEWVSNIDPYYDYTSYNLKFKDRFTISRDNAKNSLYLQMNSLRAEDTAVYYCARSTMITPFDYWGQGTLVTVSS

SEQ ID NO: 15 - protein, 118 aa, Artificial Sequence
  Description of Artificial Sequence: Synthetic humanized antibody VH domain
EVQLVESGGGLVQPGGSLRLSCAASGYSFTGYNMNWVRQAPGKGLEWVSNIDPYYDYTSYADSVKGRFTISRDNAKNSLYLQMNSLRAEDTAVYYCARSTMITPFDYWGQGTLVTVSS

SEQ ID NO: 16 - protein, 121 aa, Artificial Sequence
  Description of Artificial Sequence: Synthetic humanized antibody VH domain
QVQLVQSGAEVKKPGASVKVSCKASGYTFSRYWIEWVRQAPGQGLEWMGEILPGSGSTNYNEKFKGRVTMTTDTSTSTAYMELRSLRSDDTAVYYCAREEVYDGYPWFGYWGQGTLVTVSS

SEQ ID NO: 17 - protein, 121 aa, Artificial Sequence
  Description of Artificial Sequence: Synthetic humanized antibody VH domain
QVQLVQSGAEVKKPGASVKVSCKASGYTFSRYWIEWVRQAPGQGLEWMGEILPGSGSTNYAQKLQGRVTMTTDTSTSTAYMELRSLRSDDTAVYYCAREEVYDGYPWFGYWGQGTLVTVSS

SEQ ID NO: 18 - protein, 121 aa, Artificial Sequence
  Description of Artificial Sequence: Synthetic humanized antibody VH domain
EVQLVESGGGLVQPGGSLRLSCAASGYTFSRYWIEWVRQAPGKGLEWVSEILPGSGSTNYNEKFKGRFTISRDNAKNSLYLQMNSLRAEDTAVYYCAREEVYDGYPWFGYWGQGTLVTVSS

SEQ ID NO: 19 - protein, 121 aa, Artificial Sequence
  Description of Artificial Sequence: Synthetic humanized antibody VH domain
EVQLVESGGGLVQPGGSLRLSCAASGYTFSRYWIEWVRQAPGKGLEWVSEILPGSGSTNYADSVKGRFTISRDNAKNSLYLQMNSLRAEDTAVYYCAREEVYDGYPWFGYWGQGTLVTVSS

SEQ ID NO: 20 - protein, 119 aa, Artificial Sequence
  Description of Artificial Sequence: Synthetic humanized antibody VH domain
QVQLVQSGAEVKKPGASVKVSCKASGYTFSTHWIEWVRQAPGQGLEWMGEILPGSGSTSYNEKFKGRVTMTTDTSTSTAYMELRSLRSDDTAVYYCARWLLYYYAMDYWGQGTLVTVSS

SEQ ID NO: 21 - protein, 119 aa, Artificial Sequence
  Description of Artificial Sequence: Synthetic humanized antibody VH domain
QVQLVQSGAEVKKPGASVKVSCKASGYTFSTHWIEWVRQAPGQGLEWMGEILPGSGSTSYAQKLQGRVTMTTDTSTSTAYMELRSLRSDDTAVYYCARWLLYYYAMDYWGQGTLVTVSS

SEQ ID NO: 22 - protein, 119 aa, Artificial Sequence
  Description of Artificial Sequence: Synthetic humanized antibody VH domain
EVQLVESGGGLVQPGGSLRLSCAASGYTFSTHWIEWVRQAPGKGLEWVSEILPGSGSTSYNEKFKGRFTISRDNAKNSLYLQMNSLRAEDTAVYYCARWLLYYYAMDYWGQGTLVTVSS

SEQ ID NO: 23 - protein, 119 aa, Artificial Sequence
  Description of Artificial Sequence: Synthetic humanized antibody VH domain
EVQLVESGGGLVQPGGSLRLSCAASGYTFSTHWIEWVRQAPGKGLEWVSEILPGSGSTSYADSVKGRFTISRDNAKNSLYLQMNSLRAEDTAVYYCARWLLYYYAMDYWGQGTLVTVSS

SEQ ID NO: 24 - protein, 112 aa, Artificial Sequence
  Description of Artificial Sequence: Synthetic humanized antibody VL domain
DIVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPWTFGQGTKLEIK

SEQ ID NO: 25 - protein, 112 aa, Artificial Sequence
  Description of Artificial Sequence: Synthetic humanized antibody VL domain
DIQMTQSPSSLSASVGDRVTITCRSSQSIVHSNGNTYLEWYQQKPGKAPKLLIYKVSNRFSGVPSRFSGSGSGTDFTLTISSLQPEDFATYYCFQGSHVPWTFGQGTKLEIK

SEQ ID NO: 26 - protein, 106 aa, Artificial Sequence
  Description of Artificial Sequence: Synthetic humanized antibody VL domain
EIVLTQSPGTLSLSPGERATLSCRASSSLSYMHWYQQKPGQAPRLLIYATSNLASGIPDRFSGSGSGTDFTLTISRLEPEDFAVYYCQQWSSNPYTFGQGTKLEIK

SEQ ID NO: 27 - protein, 106 aa, Artificial Sequence
  Description of Artificial Sequence: Synthetic humanized antibody VL domain
DIQMTQSPSSLSASVGDRVTITCRASSSLSYMHWYQQKPGKAPKLLIYATSNLASGVPSRFSGSGSGTDFTLTISSLQPEDFATYYCQQWSSNPYTFGQGTKLEIK

SEQ ID NO: 28 - protein, 112 aa, Artificial Sequence
  Description of Artificial Sequence: Synthetic humanized antibody VL domain
DIVMTQSPLSLPVTPGEPASISCRSSQSIVHSNGNTYLEWYLQKPGQSPQLLIYKLSNRFSGVPDRFSGSGSGTDFTLKISRVEAEDVGVYYCFQGSHFPYTFGQGTKLEIK

SEQ ID NO: 29 - protein, 112 aa, Artificial Sequence
  Description of Artificial Sequence: Synthetic humanized antibody VL domain
DIQMTQSPSSLSASVGDRVTITCRSSQSIVHSNGNTYLEWYQQKPGKAPKLLIYKLSNRFSGVPSRFSGSGSGTDFTLTISSLQPEDFATYYCFQGSHFPYTFGQGTKLEIK

SEQ ID NO: 30 - protein, 10 aa, Artificial Sequence
  Description of Artificial Sequence: Synthetic humanized antibody 76E1-huVH1a VH CDR1
GYSFTGYNMN

SEQ ID NO: 31 - protein, 17 aa, Artificial Sequence
  Description of Artificial Sequence: Synthetic humanized antibody 76E1-huVH1a VH CDR2
NIDPYYDYTSYNLKFKD

SEQ ID NO: 32 - protein, 9 aa, Artificial Sequence
  Description of Artificial Sequence: Synthetic humanized antibody 76E1-huVH1a VH CDR3
STMITPFDY

SEQ ID NO: 33 - protein, 10 aa, Artificial Sequence
  Description of Artificial Sequence: Synthetic humanized antibody 141A-huVH1a VH CDR1
GYTFSRYWIE

SEQ ID NO: 34 - protein, 17 aa, Artificial Sequence
  Description of Artificial Sequence: Synthetic humanized antibody 141A-huVH1a VH CDR2
EILPGSGSTNYNEKFKG

SEQ ID NO: 35 - protein, 12 aa, Artificial Sequence
  Description of Artificial Sequence: Synthetic humanized antibody 141A-huVH1a VH CDR3
EEVYDGYPWFGY

SEQ ID NO: 36 - protein, 10 aa, Artificial Sequence
  Description of Artificial Sequence: Synthetic humanized antibody 175A VH CDR1
GYTFSTHWIE

SEQ ID NO: 37 - protein, 17 aa, Artificial Sequence
  Description of Artificial Sequence: Synthetic humanized antibody 175A VH CDR2
EILPGSGSTSYNEKFKG

SEQ ID NO: 38 - protein, 10 aa, Artificial Sequence
  Description of Artificial Sequence: Synthetic humanized antibody 175A VH CDR3
WLLYYYAMDY

SEQ ID NO: 39 - protein, 25 aa, Artificial Sequence
  Description of Artificial Sequence: Synthetic humanized antibody 141A-huVH1a VH FR1
QVQLVQSGAEVMKPGASVKVSCKAS

SEQ ID NO: 40 - protein, 7 aa, Artificial Sequence
  Description of Artificial Sequence: Synthetic humanized antibody 76E1-huVK1 VL CDR2
KVSNRFS

SEQ ID NO: 41 - protein, 9 aa, Artificial Sequence
  Description of Artificial Sequence: Synthetic humanized antibody 76E1-huVK2 VL CDR3
FQGSHVPWT

SEQ ID NO: 42 - protein, 10 aa, Artificial Sequence
  Description of Artificial Sequence: Synthetic humanized antibody 141A-huVK3 VL CDR1
RASSSLSYMH

SEQ ID NO: 43 - protein, 7 aa, Artificial Sequence
  Description of Artificial Sequence: Synthetic humanized antibody 76E1-huVK2 VL CDR3
ATSNLAS

SEQ ID NO: 44 - protein, 9 aa, Artificial Sequence
  Description of Artificial Sequence: Synthetic humanized antibody 141A-huVK3 VL CDR3
QQWSSNPYT

SEQ ID NO: 45 - protein, 16 aa, Artificial Sequence
  Description of Artificial Sequence: Synthetic VL CDR1 of a humanized anti-C10orf54 antibody
RSSQSIVHSNGNTYLE

SEQ ID NO: 46 - protein, 7 aa, Artificial Sequence
  Description of Artificial Sequence: Synthetic humanized antibody 175A VL CDR2
KLSNRFS

SEQ ID NO: 47 - protein, 9 aa, Artificial Sequence
  Description of Artificial Sequence: Synthetic humanized antibody 175A VL CDR3
FQGSHFPYT

SEQ ID NO: 48 - skipped

SEQ ID NO: 49 - protein, 17 aa, Artificial Sequence
  Description of Artificial Sequence: Synthetic humanized antibody 141A-huVH1b VH CDR2
EILPGSGSTNYAQKLQG

SEQ ID NO: 50 - protein, 17 aa, Artificial Sequence
  Description of Artificial Sequence: Synthetic humanized antibody 175A-huVH1b VH CDR2
EILPGSGSTSYAQKLQG

SEQ ID NO: 51 - protein, 25 aa, Artificial Sequence [sequence omitted]

SEQ ID NO: 52 - protein, 14 aa, Artificial Sequence
  Description of Artificial Sequence: Synthetic humanized antibody 141A-huVH1b VH FR2
WVRQAPGQGLEWMG

SEQ ID NO: 53 - protein, 32 aa, Artificial Sequence
  Description of Artificial Sequence: Synthetic humanized antibody 175A-huVH1b VH FR3
RVTMTTDTSTSTAYMELRSLRSDDTAVYYCAR

SEQ ID NO: 54 - protein, 11 aa, Artificial Sequence
  Description of Artificial Sequence: Synthetic humanized antibody 141A-huVH1b VH FR4
WGQGTLVTVSS

SEQ ID NO: 55 - protein, 25 aa, Artificial Sequence [sequence omitted]

SEQ ID NO: 56 - protein, 14 aa, Artificial Sequence
  Description of Artificial Sequence: Synthetic humanized antibody 175A-huVH3a VH FR2
WVRQAPGKGLEWVS

SEQ ID NO: 57 - protein, 32 aa, Artificial Sequence
  Description of Artificial Sequence: Synthetic humanized antibody 141A-huVH3 VH FR3
RFTISRDNAKNSLYLQMNSLRAEDTAVYYCAR

SEQ ID NO: 58 - protein, 25 aa, Artificial Sequence
  Description of Artificial Sequence: Synthetic humanized antibody 141A-huVH1a VH FR1
QVQLVQSGAEVMKPGASVKISCKAS

SEQ ID NO: 59 - protein, 10 aa, Artificial Sequence
  Description of Artificial Sequence: Synthetic humanized antibody 76E1-huVH1a VH CDR1
GYSFTGYQMN

SEQ ID NO: 60 - protein, 10 aa, Artificial Sequence
  Description of Artificial Sequence: Synthetic humanized antibody 76E1-huVH1a VH CDR1
GYSFTGYSMN

SEQ ID NO: 61 - protein, 10 aa, Artificial Sequence
  Description of Artificial Sequence: Synthetic humanized antibody 76E1-huVH1a VH CDR1
GYSFTGYDMN

SEQ ID NO: 62 - protein, 10 aa, Artificial Sequence
  Description of Artificial Sequence: Synthetic humanized antibody 76E1-huVH1a VH CDR1
GYSFTGYAMN

SEQ ID NO: 63 - protein, 14 aa, Artificial Sequence
  Description of Artificial Sequence: Synthetic humanized antibody 76E1-huVH1a VH FR2
WVRQAPGQSLEWMG

SEQ ID NO: 64 - protein, 14 aa, Artificial Sequence
  Description of Artificial Sequence: Synthetic humanized antibody 76E1-huVH1a VH FR2
WVRQAPGQSLEWIG

SEQ ID NO: 65 - protein, 17 aa, Artificial Sequence
  Description of Artificial Sequence: Synthetic humanized antibody 76E1-huVH1a VH CDR2
NIEPYYDYTSYNLKFKD

SEQ ID NO: 66 - protein, 17 aa, Artificial Sequence
  Description of Artificial Sequence: Synthetic humanized antibody 76E1-huVH1a VH CDR2
NISPYYDYTSYNLKFKD

SEQ ID NO: 67 - protein, 17 aa, Artificial Sequence
  Description of Artificial Sequence: Synthetic humanized antibody 76E1-huVH1a VH CDR2
NIAPYYDYTSYNLKFKD

SEQ ID NO: 68 - protein, 17 aa, Artificial Sequence
  Description of Artificial Sequence: Synthetic humanized antibody 76E1-huVH1a VH CDR2
NIDPYYDYTSYQLKFKD

SEQ ID NO: 69 - protein, 17 aa, Artificial Sequence
  Description of Artificial Sequence: Synthetic humanized antibody 76E1-huVH1a VH CDR2
NIDPYYDYTSYSLKFKD

SEQ ID NO: 70 - protein, 17 aa, Artificial Sequence
  Description of Artificial Sequence: Synthetic humanized antibody 76E1-huVH1a VH CDR2
NIDPYYDYTSYDLKFKD

SEQ ID NO: 71 - protein, 17 aa, Artificial Sequence
  Description of Artificial Sequence: Synthetic humanized antibody 76E1-huVH1a VH CDR2
NIDPYYDYTSYALKFKD

SEQ ID NO: 72 - protein, 17 aa, Artificial Sequence
  Description of Artificial Sequence: Synthetic humanized antibody 76E1-huVH1a VH CDR2
NIEPYYDYTSYQLKFKD

SEQ ID NO: 73 - protein, 17 aa, Artificial Sequence
  Description of Artificial Sequence: Synthetic humanized antibody 76E1-huVH1a VH CDR2
NIEPYYDYTSYSLKFKD

SEQ ID NO: 74 - protein, 17 aa, Artificial Sequence
  Description of Artificial Sequence: Synthetic humanized antibody 76E1-huVH1a VH CDR2
NIEPYYDYTSYDLKFKD

SEQ ID NO: 75 - protein, 23 aa, Artificial Sequence
  Description of Artificial Sequence: Synthetic humanized antibody 175A-huVK2 VL FR1
DIVMTQSPLSLPVTPGEPASISC

SEQ ID NO: 76 - protein, 15 aa, Artificial Sequence
  Description of Artificial Sequence: Synthetic humanized antibody 175A-huVK2 VL FR2
WYLQKPGQSPQLLIY

SEQ ID NO: 77 - protein, 32 aa, Artificial Sequence
  Description of Artificial Sequence: Synthetic humanized antibody 175A-huVK2 VL FR3
GVPDRFSGSGSGTDFTLKISRVEAEDVGVYYC

SEQ ID NO: 78 - protein, 10 aa, Artificial Sequence
  Description of Artificial Sequence: Synthetic humanized antibody 175A-huVK2 VL FR4
FGQGTKLEIK

SEQ ID NO: 79 - protein, 23 aa, Artificial Sequence
  Description of Artificial Sequence: Synthetic humanized antibody 175A-huVK1 VL FR1
DIQMTQSPSSLSASVGDRVTITC

SEQ ID NO: 80 - protein, 15 aa, Artificial Sequence
  Description of Artificial Sequence: Synthetic humanized antibody 175A-huVK1 VL FR2
WYQQKPGKAPKLLIY

SEQ ID NO: 81 - protein, 32 aa, Artificial Sequence
  Description of Artificial Sequence: Synthetic humanized antibody 175A-huVK1 VL FR3
GVPSRFSGSGSGTDFTLTISSLQPEDFATYYC

SEQ ID NO: 82 - protein, 15 aa, Homo sapiens
  Joining region IMGT IGHJ4-01
YFDYWGQGTLVTVSS

SEQ ID NO: 83 - protein, 17 aa, Artificial Sequence
  Description of Artificial Sequence: Synthetic humanized antibody 76E1-huVH1a VH CDR2
NIEPYYDYTSYALKFKD

SEQ ID NO: 84 - protein, 17 aa, Artificial Sequence
  Description of Artificial Sequence: Synthetic humanized antibody 76E1-huVH1a VH CDR2
NISPYYDYTSYQLKFKD

SEQ ID NO: 85 - protein, 17 aa, Artificial Sequence
  Description of Artificial Sequence: Synthetic humanized antibody 76E1-huVH1a VH CDR2
NISPYYDYTSYSLKFKD

SEQ ID NO: 86 - protein, 17 aa, Artificial Sequence
  Description of Artificial Sequence: Synthetic humanized antibody 76E1-huVH1a VH CDR2
NISPYYDYTSYDLKFKD

SEQ ID NO: 87 - protein, 17 aa, Artificial Sequence
  Description of Artificial Sequence: Synthetic humanized antibody 76E1-huVH1a VH CDR2
NISPYYDYTSYALKFKD

SEQ ID NO: 88 - protein, 17 aa, Artificial Sequence
  Description of Artificial Sequence: Synthetic humanized antibody 76E1-huVH1a VH CDR2
NIAPYYDYTSYQLKFKD

SEQ ID NO: 89 - protein, 17 aa, Artificial Sequence
  Description of Artificial Sequence: Synthetic humanized antibody 76E1-huVH1a VH CDR2
NIAPYYDYTSYSLKFKD

SEQ ID NO: 90 - protein, 17 aa, Artificial Sequence
  Description of Artificial Sequence: Synthetic humanized antibody 76E1-huVH1a VH CDR2
NIAPYYDYTSYDLKFKD

SEQ ID NO: 91 - protein, 23 aa, Artificial Sequence
  Description of Artificial Sequence: Synthetic humanized antibody 141A-huVK3 VL FR1
EIVLTQSPGTLSLSPGERATLSC

SEQ ID NO: 92 - protein, 15 aa, Artificial Sequence
  Description of Artificial Sequence: Synthetic humanized antibody 141A-huVK3 VL FR2
WYQQKPGQAPRLLIY

SEQ ID NO: 93 - protein, 32 aa, Artificial Sequence
  Description of Artificial Sequence: Synthetic humanized antibody 141A-huVK3 VL FR3
GIPDRFSGSGSGTDFTLTISRLEPEDFAVYYC

SEQ ID NO: 94 - protein, 12 aa, Homo sapiens
  Joining region IMGT IGKJ2-01
YTFGQGTKLEIK

SEQ ID NO: 95 - protein, 17 aa, Artificial Sequence
  Description of Artificial Sequence: Synthetic humanized antibody 76E1-huVH1a VH CDR2
NIAPYYDYTSYALKFKD

SEQ ID NO: 96 - protein, 32 aa, Artificial Sequence
  Description of Artificial Sequence: Synthetic humanized antibody 76E1-huVH1a VH FR3
RVTLTTDTSTSTAYMELRSLRSDDTAVYYCAR

SEQ ID NO: 97 - protein, 32 aa, Artificial Sequence
  Description of Artificial Sequence: Synthetic humanized antibody 76E1-huVH1a VH FR3
RVTMTVDTSTSTAYMELRSLRSDDTAVYYCAR

SEQ ID NO: 98 - protein, 32 aa, Artificial Sequence
  Description of Artificial Sequence: Synthetic humanized antibody 76E1-huVH1a VH FR3
RVTMTTDKSTSTAYMELRSLRSDDTAVYYCAR

SEQ ID NO: 99 - protein, 17 aa, Artificial Sequence
  Description of Artificial Sequence: Synthetic humanized antibody 175A-huVH3b VH CDR2
EILPGSGSTSYADSVKG

SEQ ID NO: 100 - protein, 17 aa, Artificial Sequence
  Description of Artificial Sequence: Synthetic humanized antibody 175A-huVH3b VH CDR2
EILPGSGSTSYADSFKG

SEQ ID NO: 101 - protein, 17 aa, Artificial Sequence
  Description of Artificial Sequence: Synthetic humanized antibody 175A-huVH1a VH CDR2
EILPGSGSTSYQEKFKG

SEQ ID NO: 102 - protein, 17 aa, Artificial Sequence
  Description of Artificial Sequence: Synthetic humanized antibody 175A-huVH1a VH CDR2
EILPGSGSTSYSEKFKG

SEQ ID NO: 103 - protein, 17 aa, Artificial Sequence
  Description of Artificial Sequence: Synthetic humanized antibody 175A-huVH1a VH CDR2
EILPGSGSTSYDEKFKG

SEQ ID NO: 104 - protein, 17 aa, Artificial Sequence
  Description of Artificial Sequence: Synthetic humanized antibody 175A-huVH1a VH CDR2
EILPGSGSTSYAEKFKG

SEQ ID NO: 105 - protein, 25 aa, Artificial Sequence
  Description of Artificial Sequence: Synthetic humanized antibody 175A-huVH1a VH FR1
QVQLVQSGAEVKKPGASVKISCKAS

SEQ ID NO: 106 - protein, 14 aa, Artificial Sequence
  Description of Artificial Sequence: Synthetic humanized antibody 175A-huVH1a VH FR2
WVRQAPGQGLEWIG

SEQ ID NO: 107 - protein, 32 aa, Artificial Sequence
  Description of Artificial Sequence: Synthetic humanized antibody 175A-huVH1 VH FR3
RATMTTDTSTSTAYMELRSLRSDDTAVYYCAR

SEQ ID NO: 108 - protein, 32 aa, Artificial Sequence
  Description of Artificial Sequence: Synthetic humanized antibody 175A-huVH1 VH FR3
RVTFTTDTSTSTAYMELRSLRSDDTAVYYCAR

SEQ ID NO: 109 - protein, 32 aa, Artificial Sequence
  Description of Artificial Sequence: Synthetic humanized antibody 175A-huVH1 VH FR3
RVTMTADTSTSTAYMELRSLRSDDTAVYYCAR

SEQ ID NO: 110 - protein, 32 aa, Artificial Sequence
  Description of Artificial Sequence: Synthetic humanized antibody 175A-huVH1 VH FR3
RATFTTDTSTSTAYMELRSLRSDDTAVYYCAR

SEQ ID NO: 111 - protein, 32 aa, Artificial Sequence
  Description of Artificial Sequence: Synthetic humanized antibody 175A-huVH1 VH FR3
RVTFTADTSTSTAYMELRSLRSDDTAVYYCAR

SEQ ID NO: 112 - protein, 32 aa, Artificial Sequence
  Description of Artificial Sequence: Synthetic humanized antibody 175A-huVH1 VH FR3
RATMTADTSTSTAYMELRSLRSDDTAVYYCAR

SEQ ID NO: 113 - protein, 32 aa, Artificial Sequence
  Description of Artificial Sequence: Synthetic humanized antibody 175A-huVH1 VH FR3
RATFTADTSTSTAYMELRSLRSDDTAVYYCAR

SEQ ID NO: 114 - protein, 17 aa, Artificial Sequence
  Description of Artificial Sequence: Synthetic humanized antibody 175A-huVH1b VH CDR2
EILPGSGSTSYAQKFQG

SEQ ID NO: 115 - protein, 25 aa, Artificial Sequence
  Description of Artificial Sequence: Synthetic humanized antibody 175A-huVH3a VH FR1
EVQLVQSGGGLVQPGGSLRLSCAAS

SEQ ID NO: 116 - protein, 25 aa, Artificial Sequence
  Description of Artificial Sequence: Synthetic humanized antibody 175A-huVH3a VH FR1
EVQLVESGGGLVQPGGSVRLSCAAS

SEQ ID NO: 117 - protein, 25 aa, Artificial Sequence
  Description of Artificial Sequence: Synthetic humanized antibody 175A-huVH3a VH FR1
EVQLVESGGGLVQPGGSLRISCAAS

SEQ ID NO: 118 - protein, 25 aa, Artificial Sequence
  Description of Artificial Sequence: Synthetic humanized antibody 175A-huVH3a VH FR1
EVQLVQSGGGLVQPGGSVRLSCAAS

SEQ ID NO: 119 - protein, 25 aa, Artificial Sequence
  Description of Artificial Sequence: Synthetic humanized antibody 175A-huVH3a VH FR1
EVQLVESGGGLVQPGGSVRISCAAS

SEQ ID NO: 120 - protein, 25 aa, Artificial Sequence
  Description of Artificial Sequence: Synthetic humanized antibody 175A-huVH3a VH FR1
EVQLVQSGGGLVQPGGSLRISCAAS

SEQ ID NO: 121 - protein, 25 aa, Artificial Sequence
  Description of Artificial Sequence: Synthetic humanized antibody 175A-huVH3a VH FR1
EVQLVQSGGGLVQPGGSVRISCAAS

SEQ ID NO: 122 - protein, 14 aa, Artificial Sequence
  Description of Artificial Sequence: Synthetic humanized antibody 175A-huVH3a VH FR2
WVRQAPGKGLEWIS

SEQ ID NO: 123 - protein, 14 aa, Artificial Sequence
  Description of Artificial Sequence: Synthetic humanized antibody 175A-huVH3a VH FR2
WVRQAPGKGLEWVG

SEQ ID NO: 124 - protein, 14 aa, Artificial Sequence
  Description of Artificial Sequence: Synthetic humanized antibody 175A-huVH3a VH FR2
WVRQAPGKGLEWIG

SEQ ID NO: 125 - protein, 32 aa, Artificial Sequence
  Description of Artificial Sequence: Synthetic humanized antibody 175A-huVH3 VH FR3
RATISRDNAKNSLYLQMNSLRAEDTAVYYCAR

SEQ ID NO: 126 - protein, 32 aa, Artificial Sequence
  Description of Artificial Sequence: Synthetic humanized antibody 175A-huVH3 VH FR3
RFTFSRDNAKNSLYLQMNSLRAEDTAVYYCAR

SEQ ID NO: 127 - protein, 32 aa, Artificial Sequence
  Description of Artificial Sequence: Synthetic humanized antibody 175A-huVH3 VH FR3
RFTISADNAKNSLYLQMNSLRAEDTAVYYCAR

SEQ ID NO: 128 - protein, 32 aa, Artificial Sequence
  Description of Artificial Sequence: Synthetic humanized antibody 175A-huVH3 VH FR3
RFTISRDTAKNSLYLQMNSLRAEDTAVYYCAR

SEQ ID NO: 129 - protein, 32 aa, Artificial Sequence
  Description of Artificial Sequence: Synthetic humanized antibody 175A-huVH3 VH FR3
RFTISRDNAKNSAYLQMNSLRAEDTAVYYCAR

SEQ ID NO: 130 - protein, 32 aa, Artificial Sequence
  Description of Artificial Sequence: Synthetic humanized antibody 175A-huVH3 VH FR3
RFTISRDNAKNSLYMQMNSLRAEDTAVYYCAR

SEQ ID NO: 131 - protein, 32 aa, Artificial Sequence
  Description of Artificial Sequence: Synthetic humanized antibody 175A-huVH3 VH FR3
RFTISRDNAKNSLYLQLNSLRAEDTAVYYCAR

SEQ ID NO: 132 - protein, 32 aa, Artificial Sequence
  Description of Artificial Sequence: Synthetic humanized antibody 175A-huVH3 VH FR3
RATFSRDNAKNSLYLQMNSLRAEDTAVYYCAR

SEQ ID NO: 133 - protein, 32 aa, Artificial Sequence
  Description of Artificial Sequence: Synthetic humanized antibody 175A-huVH3 VH FR3
RATISADNAKNSLYLQMNSLRAEDTAVYYCAR

SEQ ID NO: 134 - protein, 32 aa, Artificial Sequence
  Description of Artificial Sequence: Synthetic humanized antibody 175A-huVH3 VH FR3
RATISRDTAKNSLYLQMNSLRAEDTAVYYCAR

SEQ ID NO: 135 - protein, 32 aa, Artificial Sequence
  Description of Artificial Sequence: Synthetic humanized antibody 175A-huVH3 VH FR3
RATISRDNAKNSAYLQMNSLRAEDTAVYYCAR

SEQ ID NO: 136 - protein, 32 aa, Artificial Sequence
  Description of Artificial Sequence: Synthetic humanized antibody 175A-huVH3 VH FR3
RATISRDNAKNSLYMQMNSLRAEDTAVYYCAR

SEQ ID NO: 137 - protein, 32 aa, Artificial Sequence
  Description of Artificial Sequence: Synthetic humanized antibody 175A-huVH3 VH FR3
RATISRDNAKNSLYLQLNSLRAEDTAVYYCAR

SEQ ID NO: 138 - protein, 32 aa, Artificial Sequence
  Description of Artificial Sequence: Synthetic humanized antibody 175A-huVH3 VH FR3
RFTFSADNAKNSLYLQMNSLRAEDTAVYYCAR

SEQ ID NO: 139 - protein, 32 aa, Artificial Sequence
  Description of Artificial Sequence: Synthetic humanized antibody 175A-huVH3 VH FR3
RFTFSRDTAKNSLYLQMNSLRAEDTAVYYCAR

SEQ ID NO: 140 - protein, 32 aa, Artificial Sequence
  Description of Artificial Sequence: Synthetic humanized antibody 175A-huVH3 VH FR3
RFTFSRDNAKNSAYLQMNSLRAEDTAVYYCAR

SEQ ID NO: 141 - protein, 32 aa, Artificial Sequence
  Description of Artificial Sequence: Synthetic humanized antibody 175A-huVH3 VH FR3
RFTFSRDNAKNSLYMQMNSLRAEDTAVYYCAR

SEQ ID NO: 142 - protein, 32 aa, Artificial Sequence
  Description of Artificial Sequence: Synthetic humanized antibody 175A-huVH3 VH FR3
RFTFSRDNAKNSLYLQLNSLRAEDTAVYYCAR

SEQ ID NO: 143 - protein, 32 aa, Artificial Sequence
  Description of Artificial Sequence: Synthetic humanized antibody 175A-huVH3 VH FR3
RFTISADTAKNSLYLQMNSLRAEDTAVYYCAR

SEQ ID NO: 144 - protein, 32 aa, Artificial Sequence
  Description of Artificial Sequence: Synthetic humanized antibody 175A-huVH3 VH FR3
RFTISADNAKNSAYLQMNSLRAEDTAVYYCAR

SEQ ID NO: 145 - protein, 32 aa, Artificial Sequence
  Description of Artificial Sequence: Synthetic humanized antibody 175A-huVH3 VH FR3
RFTISADNAKNSLYMQMNSLRAEDTAVYYCAR

SEQ ID NO: 146 - protein, 32 aa, Artificial Sequence
  Description of Artificial Sequence: Synthetic humanized antibody 175A-huVH3 VH FR3
RFTISADNAKNSLYLQLNSLRAEDTAVYYCAR

SEQ ID NO: 147 - protein, 32 aa, Artificial Sequence
  Description of Artificial Sequence: Synthetic humanized antibody 175A-huVH3 VH FR3
RFTISRDTAKNSAYLQMNSLRAEDTAVYYCAR

SEQ ID NO: 148 - protein, 32 aa, Artificial Sequence
  Description of Artificial Sequence: Synthetic humanized antibody 175A-huVH3 VH FR3
RFTISRDTAKNSLYMQMNSLRAEDTAVYYCAR

SEQ ID NO: 149 - protein, 32 aa, Artificial Sequence
  Description of Artificial Sequence: Synthetic humanized antibody 175A-huVH3 VH FR3
RFTISRDTAKNSLYLQLNSLRAEDTAVYYCAR

SEQ ID NO: 150 - protein, 32 aa, Artificial Sequence
  Description of Artificial Sequence: Synthetic humanized antibody 175A-huVH3 VH FR3
RFTISRDNAKNSAYMQMNSLRAEDTAVYYCAR

SEQ ID NO: 151 - protein, 32 aa, Artificial Sequence
  Description of Artificial Sequence: Synthetic humanized antibody 175A-huVH3 VH FR3
RFTISRDNAKNSAYLQLNSLRAEDTAVYYCAR

SEQ ID NO: 152 - protein, 32 aa, Artificial Sequence
  Description of Artificial Sequence: Synthetic humanized antibody 175A-huVH3 VH FR3
RFTISRDNAKNSLYMQLNSLRAEDTAVYYCAR

SEQ ID NO: 153 - protein, 32 aa, Artificial Sequence
  Description of Artificial Sequence: Synthetic humanized antibody 175A-huVH3 VH FR3
RATFSADNAKNSLYLQMNSLRAEDTAVYYCAR

SEQ ID NO: 154 - protein, 32 aa, Artificial Sequence
  Description of Artificial Sequence: Synthetic humanized antibody 175A-huVH3 VH FR3
RATFSRDTAKNSLYLQMNSLRAEDTAVYYCAR

SEQ ID NO: 155 - protein, 32 aa, Artificial Sequence
  Description of Artificial Sequence: Synthetic humanized antibody 175A-huVH3 VH FR3
RATFSRDNAKNSAYLQMNSLRAEDTAVYYCAR

SEQ ID NO: 156 - protein, 32 aa, Artificial Sequence
  Description of Artificial Sequence: Synthetic humanized antibody 175A-huVH3 VH FR3
RATFSRDNAKNSLYMQMNSLRAEDTAVYYCAR

SEQ ID NO: 157 - protein, 32 aa, Artificial Sequence
  Description of Artificial Sequence: Synthetic humanized antibody 175A-huVH3 VH FR3
RATFSRDNAKNSLYLQLNSLRAEDTAVYYCAR

SEQ ID NO: 158 - protein, 32 aa, Artificial Sequence
  Description of Artificial Sequence: Synthetic humanized antibody 175A-huVH3 VH FR3
RATISADTAKNSLYLQMNSLRAEDTAVYYCAR

SEQ ID NO: 159 - protein, 32 aa, Artificial Sequence
  Description of Artificial Sequence: Synthetic humanized antibody 175A-huVH3 VH FR3
RATISADNAKNSAYLQMNSLRAEDTAVYYCAR

SEQ ID NO: 160 - protein, 32 aa, Artificial Sequence
  Description of Artificial Sequence: Synthetic humanized antibody 175A-huVH3 VH FR3
RATISADNAKNSLYMQMNSLRAEDTAVYYCAR

SEQ ID NO: 161 - protein, 32 aa, Artificial Sequence
  Description of Artificial Sequence: Synthetic humanized antibody 175A-huVH3 VH FR3
RATISADNAKNSLYLQLNSLRAEDTAVYYCAR

SEQ ID NO: 162 - protein, 32 aa, Artificial Sequence
  Description of Artificial Sequence: Synthetic humanized antibody 175A-huVH3 VH FR3
RATISRDTAKNSAYLQMNSLRAEDTAVYYCAR

SEQ ID NO: 163 - protein, 32 aa, Artificial Sequence
  Description of Artificial Sequence: Synthetic humanized antibody 175A-huVH3 VH FR3
RATISRDTAKNSLYMQMNSLRAEDTAVYYCAR

SEQ ID NO: 164 - protein, 32 aa, Artificial Sequence
  Description of Artificial Sequence: Synthetic humanized antibody 175A-huVH3 VH FR3
RATISRDTAKNSLYLQLNSLRAEDTAVYYCAR

SEQ ID NO: 165 - protein, 32 aa, Artificial Sequence
  Description of Artificial Sequence: Synthetic humanized antibody 175A-huVH3 VH FR3
RATISRDNAKNSAYMQMNSLRAEDTAVYYCAR

SEQ ID NO: 166 - protein, 32 aa, Artificial Sequence
  Description of Artificial Sequence: Synthetic humanized antibody 175A-huVH3 VH FR3
RATISRDNAKNSAYLQLNSLRAEDTAVYYCAR

SEQ ID NO: 167 - protein, 32 aa, Artificial Sequence
  Description of Artificial Sequence: Synthetic humanized antibody 175A-huVH3 VH FR3
RATISRDNAKNSLYMQLNSLRAEDTAVYYCAR

SEQ ID NO: 168 - protein, 32 aa, Artificial Sequence
  Description of Artificial Sequence: Synthetic humanized antibody 175A-huVH3 VH FR3
RFTFSADTAKNSLYLQMNSLRAEDTAVYYCAR

SEQ ID NO: 169 - protein, 32 aa, Artificial Sequence
  Description of Artificial Sequence: Synthetic humanized antibody 175A-huVH3 VH FR3
RFTFSADNAKNSAYLQMNSLRAEDTAVYYCAR

SEQ ID NO: 170 - protein, 32 aa, Artificial Sequence
  Description of Artificial Sequence: Synthetic humanized antibody 175A-huVH3 VH FR3
RFTFSADNAKNSLYMQMNSLRAEDTAVYYCAR

SEQ ID NO: 171 - protein, 32 aa, Artificial Sequence
  Description of Artificial Sequence: Synthetic humanized antibody 175A-huVH3 VH FR3
RFTFSADNAKNSLYLQLNSLRAEDTAVYYCAR

SEQ ID NO: 172 - protein, 32 aa, Artificial Sequence
  Description of Artificial Sequence: Synthetic humanized antibody 175A-huVH3 VH FR3
RFTFSRDTAKNSAYLQMNSLRAEDTAVYYCAR

SEQ ID NO: 173 - protein, 32 aa, Artificial Sequence
  Description of Artificial Sequence: Synthetic humanized antibody 175A-huVH3 VH FR3
RFTFSRDTAKNSLYMQMNSLRAEDTAVYYCAR

SEQ ID NO: 174 - protein, 32 aa, Artificial Sequence
  Description of Artificial Sequence: Synthetic humanized antibody 175A-huVH3 VH FR3
RFTFSRDTAKNSLYLQLNSLRAEDTAVYYCAR

SEQ ID NO: 175 - protein, 32 aa, Artificial Sequence
  Description of Artificial Sequence: Synthetic humanized antibody 175A-huVH3 VH FR3
RFTFSRDNAKNSAYMQMNSLRAEDTAVYYCAR

SEQ ID NO: 176 - protein, 32 aa, Artificial Sequence
  Description of Artificial Sequence: Synthetic humanized antibody 175A-huVH3 VH FR3
RFTFSRDNAKNSAYLQLNSLRAEDTAVYYCAR

SEQ ID NO: 177 - protein, 32 aa, Artificial Sequence
  Description of Artificial Sequence: Synthetic humanized antibody 175A-huVH3 VH FR3
RFTFSRDNAKNSLYMQLNSLRAEDTAVYYCAR

SEQ ID NO: 178 - protein, 32 aa, Artificial Sequence
  Description of Artificial Sequence: Synthetic humanized antibody 175A-huVH3 VH FR3
RFTISADTAKNSAYLQMNSLRAEDTAVYYCAR

SEQ ID NO: 179 - protein, 32 aa, Artificial Sequence
  Description of Artificial Sequence: Synthetic humanized antibody 175A-huVH3 VH FR3
RFTISADTAKNSLYMQMNSLRAEDTAVYYCAR

SEQ ID NO: 180 - protein, 32 aa, Artificial Sequence
  Description of Artificial Sequence: Synthetic humanized antibody 175A-huVH3 VH FR3
RFTISADTAKNSLYLQLNSLRAEDTAVYYCAR

SEQ ID NO: 181 - protein, 32 aa, Artificial Sequence
  Description of Artificial Sequence: Synthetic humanized antibody 175A-huVH3 VH FR3
RFTISADNAKNSAYMQMNSLRAEDTAVYYCAR

SEQ ID NO: 182 - protein, 32 aa, Artificial Sequence
  Description of Artificial Sequence: Synthetic humanized antibody 175A-huVH3 VH FR3
RFTISADNAKNSAYLQLNSLRAEDTAVYYCAR

SEQ ID NO: 183 - protein, 32 aa, Artificial Sequence
  Description of Artificial Sequence: Synthetic humanized antibody 175A-huVH3 VH FR3
RFTISADNAKNSLYMQLNSLRAEDTAVYYCAR

SEQ ID NO: 184 - protein, 32 aa, Artificial Sequence
  Description of Artificial Sequence: Synthetic humanized antibody 175A-huVH3 VH FR3
RFTISRDTAKNSAYMQMNSLRAEDTAVYYCAR

SEQ ID NO: 185 - protein, 32 aa, Artificial Sequence
  Description of Artificial Sequence: Synthetic humanized antibody 175A-huVH3 VH FR3
RFTISRDTAKNSAYLQLNSLRAEDTAVYYCAR

SEQ ID NO: 186 - protein, 32 aa, Artificial Sequence
  Description of Artificial Sequence: Synthetic humanized antibody 175A-huVH3 VH FR3
RFTISRDTAKNSLYMQLNSLRAEDTAVYYCAR

SEQ ID NO: 187 - protein, 32 aa, Artificial Sequence
  Description of Artificial Sequence: Synthetic humanized antibody 175A-huVH3 VH FR3
RFTISRDNAKNSAYMQLNSLRAEDTAVYYCAR

SEQ ID NO: 188 - protein, 32 aa, Artificial Sequence
  Description of Artificial Sequence: Synthetic humanized antibody 175A-huVH3 VH FR3
RATFSADTAKNSLYLQMNSLRAEDTAVYYCAR

SEQ ID NO: 189 - protein, 32 aa, Artificial Sequence
  Description of Artificial Sequence: Synthetic humanized antibody 175A-huVH3 VH FR3
RATFSADNAKNSAYLQMNSLRAEDTAVYYCAR

SEQ ID NO: 190 - protein, 32 aa, Artificial Sequence
  Description of Artificial Sequence: Synthetic humanized antibody 175A-huVH3 VH FR3
RATFSADNAKNSLYMQMNSLRAEDTAVYYCAR

SEQ ID NO: 191 - protein, 32 aa, Artificial Sequence
  Description of Artificial Sequence: Synthetic humanized antibody 175A-huVH3 VH FR3
RATFSADNAKNSLYLQLNSLRAEDTAVYYCAR

SEQ ID NO: 192 - protein, 32 aa, Artificial Sequence
  Description of Artificial Sequence: Synthetic humanized antibody 175A-huVH3 VH FR3
RATFSRDTAKNSAYLQMNSLRAEDTAVYYCAR

SEQ ID NO: 193 - protein, 32 aa, Artificial Sequence
  Description of Artificial Sequence: Synthetic humanized antibody 175A-huVH3 VH FR3
RATFSRDTAKNSLYMQMNSLRAEDTAVYYCAR

SEQ ID NO: 194 - protein, 32 aa, Artificial Sequence
  Description of Artificial Sequence: Synthetic humanized antibody 175A-huVH3 VH FR3
RATFSRDTAKNSLYLQLNSLRAEDTAVYYCAR

SEQ ID NO: 195 - protein, 32 aa, Artificial Sequence
  Description of Artificial Sequence: Synthetic humanized antibody 175A-huVH3 VH FR3
RATFSRDNAKNSAYMQMNSLRAEDTAVYYCAR

SEQ ID NO: 196 - protein, 32 aa, Artificial Sequence
  Description of Artificial Sequence: Synthetic humanized antibody 175A-huVH3 VH FR3
RATFSRDNAKNSAYLQLNSLRAEDTAVYYCAR

SEQ ID NO: 197 - protein, 32 aa, Artificial Sequence
  Description of Artificial Sequence: Synthetic humanized antibody 175A-huVH3 VH FR3
RATFSRDNAKNSLYMQLNSLRAEDTAVYYCAR

SEQ ID NO: 198 - protein, 32 aa, Artificial Sequence
  Description of Artificial Sequence: Synthetic humanized antibody 175A-huVH3 VH FR3
RATISADTAKNALYLQMNSLRAEDTAVYYCAR

SEQ ID NO: 199 - protein, 32 aa, Artificial Sequence
  Description of Artificial Sequence: Synthetic humanized antibody 175A-huVH3 VH FR3
RATISADTAKNSLYMQMNSLRAEDTAVYYCAR

SEQ ID NO: 200 - protein, 32 aa, Artificial Sequence
  Description of Artificial Sequence: Synthetic humanized antibody 175A-huVH3 VH FR3
RATISADTAKNSLYLQLNSLRAEDTAVYYCAR

SEQ ID NO: 201 - protein, 32 aa, Artificial Sequence
  Description of Artificial Sequence: Synthetic humanized antibody 175A-huVH3 VH FR3
RATISADNAKNSAYMQMNSLRAEDTAVYYCAR

SEQ ID NO: 202 - protein, 32 aa, Artificial Sequence
  Description of Artificial Sequence: Synthetic humanized antibody 175A-huVH3 VH FR3
RATISADNAKNSAYLQLNSLRAEDTAVYYCAR

SEQ ID NO: 203 - protein, 32 aa, Artificial Sequence
  Description of Artificial Sequence: Synthetic humanized antibody 175A-huVH3 VH FR3
RATISADNAKNSLYMQLNSLRAEDTAVYYCAR

SEQ ID NO: 204 - protein, 32 aa, Artificial Sequence
  Description of Artificial Sequence: Synthetic humanized antibody 175A-huVH3 VH FR3
RATISRDTAKNSAYMQMNSLRAEDTAVYYCAR

SEQ ID NO: 205 - protein, 32 aa, Artificial Sequence
  Description of Artificial Sequence: Synthetic humanized antibody 175A-huVH3 VH FR3
RATISRDTAKNSAYLQLNSLRAEDTAVYYCAR

SEQ ID NO: 206 - protein, 32 aa, Artificial Sequence
  Description of Artificial Sequence: Synthetic humanized antibody 175A-huVH3 VH FR3
RATISRDTAKNSLYMQLNSLRAEDTAVYYCAR

SEQ ID NO: 207 - protein, 32 aa, Artificial Sequence
  Description of Artificial Sequence: Synthetic humanized antibody 175A-huVH3 VH FR3
RATISRDNAKNSAYMQLNSLRAEDTAVYYCAR

SEQ ID NO: 208 - protein, 32 aa, Artificial Sequence
  Description of Artificial Sequence: Synthetic humanized antibody 175A-huVH3 VH FR3
RFTFSADTAKNSAYLQMNSLRAEDTAVYYCAR

SEQ ID NO: 209 - protein, 32 aa, Artificial Sequence
  Description of Artificial Sequence: Synthetic humanized antibody 175A-huVH3 VH FR3
RFTFSADTAKNSLYMQMNSLRAEDTAVYYCAR

SEQ ID NO: 210 - protein, 32 aa, Artificial Sequence
  Description of Artificial Sequence: Synthetic humanized antibody 175A-huVH3 VH FR3
RFTFSADTAKNSLYLQLNSLRAEDTAVYYCAR

SEQ ID NO: 211 - protein, 32 aa, Artificial Sequence
  Description of Artificial Sequence: Synthetic humanized antibody 175A-huVH3 VH FR3
RFTFSADNAKNSAYMQMNSLRAEDTAVYYCAR

SEQ ID NO: 212 - protein, 32 aa, Artificial Sequence
  Description of Artificial Sequence: Synthetic humanized antibody 175A-huVH3 VH FR3
RFTFSADNAKNSAYLQLNSLRAEDTAVYYCAR

SEQ ID NO: 213 - protein, 32 aa, Artificial Sequence
  Description of Artificial Sequence: Synthetic humanized antibody 175A-huVH3 VH FR3
RFTFSADNAKNSLYMQLNSLRAEDTAVYYCAR

SEQ ID NO: 214 - protein, 32 aa, Artificial Sequence
  Description of Artificial Sequence: Synthetic humanized antibody 175A-huVH3 VH FR3
RFTFSRDTAKNSAYMQMNSLRAEDTAVYYCAR

SEQ ID NO: 215 - protein, 32 aa, Artificial Sequence
  Description of Artificial Sequence: Synthetic humanized antibody 175A-huVH3 VH FR3
RFTFSRDTAKNSAYLQLNSLRAEDTAVYYCAR

SEQ ID NO: 216 - protein, 32 aa, Artificial Sequence
  Description of Artificial Sequence: Synthetic humanized antibody 175A-huVH3 VH FR3
RFTFSRDTAKNSLYMQLNSLRAEDTAVYYCAR

SEQ ID NO: 217 - protein, 32 aa, Artificial Sequence
  Description of Artificial Sequence: Synthetic humanized antibody 175A-huVH3 VH FR3
RFTFSRDNAKNSAYMQLNSLRAEDTAVYYCAR

SEQ ID NO: 218 - protein, 32 aa, Artificial Sequence
  Description of Artificial Sequence: Synthetic humanized antibody 175A-huVH3 VH FR3
RFTISADTAKNSAYMQMNSLRAEDTAVYYCAR

SEQ ID NO: 219 - protein, 32 aa, Artificial Sequence
  Description of Artificial Sequence: Synthetic humanized antibody 175A-huVH3 VH FR3
RFTISADTAKNSAYLQLNSLRAEDTAVYYCAR

SEQ ID NO: 220 - protein, 32 aa, Artificial Sequence
  Description of Artificial Sequence: Synthetic humanized antibody 175A-huVH3 VH FR3
RFTISADTAKNSLYMQLNSLRAEDTAVYYCAR

SEQ ID NO: 221 - protein, 32 aa, Artificial Sequence
  Description of Artificial Sequence: Synthetic humanized antibody 175A-huVH3 VH FR3
RFTISADNAKNSAYMQLNSLRAEDTAVYYCAR

SEQ ID NO: 222 - protein, 32 aa, Artificial Sequence
  Description of Artificial Sequence: Synthetic humanized antibody 175A-huVH3 VH FR3
RFTISRDTAKNSAYMQLNSLRAEDTAVYYCAR

SEQ ID NO: 223 - protein, 32 aa, Artificial Sequence
  Description of Artificial Sequence: Synthetic humanized antibody 175A-huVH3 VH FR3
RATFSADTAKNSAYLQMNSLRAEDTAVYYCAR

SEQ ID NO: 224 - protein, 32 aa, Artificial Sequence
  Description of Artificial Sequence: Synthetic humanized antibody 175A-huVH3 VH FR3
RATFSADTAKNSLYMQMNSLRAEDTAVYYCAR

SEQ ID NO: 225 - protein, 32 aa, Artificial Sequence
  Description of Artificial Sequence: Synthetic humanized antibody 175A-huVH3 VH FR3
RATFSADTAKNSLYLQLNSLRAEDTAVYYCAR

SEQ ID NO: 226 - protein, 32 aa, Artificial Sequence
  Description of Artificial Sequence: Synthetic humanized antibody 175A-huVH3 VH FR3
RATFSADNAKNSAYMQMNSLRAEDTAVYYCAR

SEQ ID NO: 227 - protein, 32 aa, Artificial Sequence
  Description of Artificial Sequence: Synthetic humanized antibody 175A-huVH3 VH FR3
RATFSADNAKNSAYLQLNSLRAEDTAVYYCAR

SEQ ID NO: 228 - protein, 32 aa, Artificial Sequence
  Description of Artificial Sequence: Synthetic humanized antibody 175A-huVH3 VH FR3
RATFSADNAKNSLYMQLNSLRAEDTAVYYCAR

SEQ ID NO: 229 - protein, 32 aa, Artificial Sequence
  Description of Artificial Sequence: Synthetic humanized antibody 175A-huVH3 VH FR3
RATFSRDTAKNSAYMQMNSLRAEDTAVYYCAR

SEQ ID NO: 230 - protein, 32 aa, Artificial Sequence
  Description of Artificial Sequence: Synthetic humanized antibody 175A-huVH3 VH FR3
RATFSRDTAKNSAYLQLNSLRAEDTAVYYCAR

SEQ ID NO: 231 - protein, 32 aa, Artificial Sequence
  Description of Artificial Sequence: Synthetic humanized antibody 175A-huVH3 VH FR3
RATFSRDTAKNSLYMQLNSLRAEDTAVYYCAR

SEQ ID NO: 232 - protein, 32 aa, Artificial Sequence
  Description of Artificial Sequence: Synthetic humanized antibody 175A-huVH3 VH FR3
RATFSRDNAKNSAYMQLNSLRAEDTAVYYCAR

SEQ ID NO: 233 - protein, 32 aa, Artificial Sequence
  Description of Artificial Sequence: Synthetic humanized antibody 175A-huVH3 VH FR3
RATISADTAKNALYMQMNSLRAEDTAVYYCAR

SEQ ID NO: 234 - protein, 32 aa, Artificial Sequence
  Description of Artificial Sequence: Synthetic humanized antibody 175A-huVH3 VH FR3
RATISADTAKNALYLQLNSLRAEDTAVYYCAR

SEQ ID NO: 235 - protein, 32 aa, Artificial Sequence
  Description of Artificial Sequence: Synthetic humanized antibody 175A-huVH3 VH FR3
RATISADTAKNSLYMQLNSLRAEDTAVYYCAR

SEQ ID NO: 236 - protein, 32 aa, Artificial Sequence
  Description of Artificial Sequence: Synthetic humanized antibody 175A-huVH3 VH FR3
RATISADNAKNSAYMQLNSLRAEDTAVYYCAR

SEQ ID NO: 237 - protein, 32 aa, Artificial Sequence
  Description of Artificial Sequence: Synthetic humanized antibody 175A-huVH3 VH FR3
RATISRDTAKNSAYMQLNSLRAEDTAVYYCAR

SEQ ID NO: 238 - protein, 32 aa, Artificial Sequence
  Description of Artificial Sequence: Synthetic humanized antibody 175A-huVH3 VH FR3
RFTFSADTAKNSAYMQMNSLRAEDTAVYYCAR

SEQ ID NO: 239 - protein, 32 aa, Artificial Sequence
  Description of Artificial Sequence: Synthetic humanized antibody 175A-huVH3 VH FR3
RFTFSADTAKNSAYLQLNSLRAEDTAVYYCAR

SEQ ID NO: 240 - protein, 32 aa, Artificial Sequence
  Description of Artificial Sequence: Synthetic humanized antibody 175A-huVH3 VH FR3
RFTFSADTAKNSLYMQLNSLRAEDTAVYYCAR

SEQ ID NO: 241 - protein, 32 aa, Artificial Sequence
  Description of Artificial Sequence: Synthetic humanized antibody 175A-huVH3 VH FR3
RFTFSADNAKNSAYMQLNSLRAEDTAVYYCAR

SEQ ID NO: 242 - protein, 32 aa, Artificial Sequence
  Description of Artificial Sequence: Synthetic humanized antibody 175A-huVH3 VH FR3
RFTFSRDTAKNSAYMQLNSLRAEDTAVYYCAR

SEQ ID NO: 243 - protein, 32 aa, Artificial Sequence
  Description of Artificial Sequence: Synthetic humanized antibody 175A-huVH3 VH FR3
RFTISADTAKNSAYMQLNSLRAEDTAVYYCAR

SEQ ID NO: 244 - protein, 32 aa, Artificial Sequence
  Description of Artificial Sequence: Synthetic humanized antibody 175A-huVH3 VH FR3
RATFSADTAKNSAYMQMNSLRAEDTAVYYCAR

SEQ ID NO: 245 - protein, 32 aa, Artificial Sequence
  Description of Artificial Sequence: Synthetic humanized antibody 175A-huVH3 VH FR3
RATFSADTAKNSAYLQLNSLRAEDTAVYYCAR

SEQ ID NO: 246 - protein, 32 aa, Artificial Sequence
  Description of Artificial Sequence: Synthetic humanized antibody 175A-huVH3 VH FR3
RATFSADTAKNSLYMQLNSLRAEDTAVYYCAR

SEQ ID NO: 247 - protein, 32 aa, Artificial Sequence
  Description of Artificial Sequence: Synthetic humanized antibody 175A-huVH3 VH FR3
RATFSADNAKNSAYMQLNSLRAEDTAVYYCAR

SEQ ID NO: 248 - protein, 32 aa, Artificial Sequence
  Description of Artificial Sequence: Synthetic humanized antibody 175A-huVH3 VH FR3
RATFSRDTAKNSAYMQLNSLRAEDTAVYYCAR

SEQ ID NO: 249 - protein, 32 aa, Artificial Sequence
  Description of Artificial Sequence: Synthetic humanized antibody 175A-huVH3 VH FR3
RATISADTAKNALYMQLNSLRAEDTAVYYCAR

SEQ ID NO: 250 - protein, 32 aa, Artificial Sequence
  Description of Artificial Sequence: Synthetic humanized antibody 175A-huVH3 VH FR3
RFTFSADTAKNSAYMQLNSLRAEDTAVYYCAR

SEQ ID NO: 251 - protein, 32 aa, Artificial Sequence
  Description of Artificial Sequence: Synthetic humanized antibody 175A-huVH3 VH FR3
RATFSADTAKNSAYMQLNSLRAEDTAVYYCAR

SEQ ID NO: 252 - protein, 23 aa, Artificial Sequence
  Description of Artificial Sequence: Synthetic humanized antibody 175A-huVK2 VL FR1
DVVMTQSPLSLPVTPGEPASISC

SEQ ID NO: 253 - protein, 16 aa, Artificial Sequence
  Description of Artificial Sequence: Synthetic humanized antibody 175A-huVK2 VL CDR1
RSSQSIVHSQGNTYLE

SEQ ID NO: 254 - protein, 16 aa, Artificial Sequence
  Description of Artificial Sequence: Synthetic humanized antibody 175A-huVK2 VL CDR1
RSSQSIVHSSGNTYLE

SEQ ID NO: 255 - protein, 16 aa, Artificial Sequence
  Description of Artificial Sequence: Synthetic humanized antibody 175A-huVK2 VL CDR1
RSSQSIVHSAGNTYLE

SEQ ID NO: 256 - protein, 16 aa, Artificial Sequence
  Description of Artificial Sequence: Synthetic humanized antibody 175A-huVK2 VL CDR1
RSSQSIVHSNGQTYLE

SEQ ID NO: 257 - protein, 16 aa, Artificial Sequence
  Description of Artificial Sequence: Synthetic humanized antibody 175A-huVK2 VL CDR1
RSSQSIVHSNGSTYLE

SEQ ID NO: 258 - protein, 16 aa, Artificial Sequence
  Description of Artificial Sequence: Synthetic humanized antibody 175A-huVK2 VL CDR1
RSSQSIVHSNGATYLE

SEQ ID NO: 259 - protein, 16 aa, Artificial Sequence
  Description of Artificial Sequence: Synthetic humanized antibody 175A-huVK2 VL CDR1
RSSQSIVHSNGDTYLE

SEQ ID NO: 260 - protein, 16 aa, Artificial Sequence
  Description of Artificial Sequence: Synthetic humanized antibody 175A-huVK2 VL CDR1
RSSQSIVHSQGQTYLE

SEQ ID NO: 261 - protein, 16 aa, Artificial Sequence
  Description of Artificial Sequence: Synthetic humanized antibody 175A-huVK2 VL CDR1
RSSQSIVHSQGSTYLE

SEQ ID NO: 262 - protein, 16 aa, Artificial Sequence
  Description of Artificial Sequence: Synthetic humanized antibody 175A-huVK2 VL CDR1
RSSQSIVHSQGATYLE

SEQ ID NO: 263 - protein, 16 aa, Artificial Sequence
  Description of Artificial Sequence: Synthetic humanized antibody 175A-huVK2 VL CDR1
RSSQSIVHSQGDTYLE

SEQ ID NO: 264 - protein, 16 aa, Artificial Sequence
  Description of Artificial Sequence: Synthetic humanized antibody 175A-huVK2 VL CDR1
RSSQSIVHSSGQTYLE

SEQ ID NO: 265 - protein, 16 aa, Artificial Sequence
  Description of Artificial Sequence: Synthetic humanized antibody 175A-huVK2 VL CDR1
RSSQSIVHSSGSTYLE

SEQ ID NO: 266 - protein, 16 aa, Artificial Sequence
  Description of Artificial Sequence: Synthetic humanized antibody 175A-huVK2 VL CDR1
RSSQSIVHSSGATYLE

SEQ ID NO: 267 - protein, 16 aa, Artificial Sequence
  Description of Artificial Sequence: Synthetic humanized antibody 175A-huVK2 VL CDR1
RSSQSIVHSSGDTYLE

SEQ ID NO: 268 - protein, 16 aa, Artificial Sequence
  Description of Artificial Sequence: Synthetic humanized antibody 175A-huVK2 VL CDR1
RSSQSIVHSAGQTYLE

SEQ ID NO: 269 - protein, 16 aa, Artificial Sequence
  Description of Artificial Sequence: Synthetic humanized antibody 175A-huVK2 VL CDR1
RSSQSIVHSAGSTYLE

SEQ ID NO: 270 - protein, 16 aa, Artificial Sequence
  Description of Artificial Sequence: Synthetic humanized antibody 175A-huVK2 VL CDR1
RSSQSIVHSAGATYLE

SEQ ID NO: 271 - protein, 16 aa, Artificial Sequence
  Description of Artificial Sequence: Synthetic humanized antibody 175A-huVK2 VL CDR1
RSSQSIVHSAGDTYLE

SEQ ID NO: 272 - protein, 7 aa, Artificial Sequence
  Description of Artificial Sequence: Synthetic humanized antibody 175A-huVK2 VL CDR2
KLSQRFS

SEQ ID NO: 273 - protein, 7 aa, Artificial Sequence
  Description of Artificial Sequence: Synthetic humanized antibody 175A-huVK2 VL CDR2
KLSSRFS

SEQ ID NO: 274 - protein, 7 aa, Artificial Sequence
  Description of Artificial Sequence: Synthetic humanized antibody 175A-huVK2 VL CDR2
KLSARFS

SEQ ID NO: 275 - protein, 7 aa, Artificial Sequence
  Description of Artificial Sequence: Synthetic humanized antibody 175A-huVK2 VL CDR2
KLSDRFS

SEQ ID NO: 276 - protein, 32 aa, Artificial Sequence
  Description of Artificial Sequence: Synthetic humanized antibody 175A-huVK2 VL FR3
GVPDRFSGSGSGTDFTLKISRVEAEDLGVYYC

SEQ ID NO: 277 - protein, 23 aa, Artificial Sequence
  Description of Artificial Sequence: Synthetic humanized antibody 175A-huVK1 VL FR1
DVQMTQSPSSLSASVGDRVTITC

SEQ ID NO: 278 - protein, 23 aa, Artificial Sequence
  Description of Artificial Sequence: Synthetic humanized antibody 175A-huVK1 VL FR1
DIQMTQSPSSLSVSVGDRVTITC

SEQ ID NO: 279 - protein, 23 aa, Artificial Sequence
  Description of Artificial Sequence: Synthetic humanized antibody 175A-huVK1 VL FR1
DIQMTQSPSSLSASVGDRATITC

SEQ ID NO: 280 - protein, 23 aa, Artificial Sequence
  Description of Artificial Sequence: Synthetic humanized antibody 175A-huVK1 VL FR1
DVQMTQSPSSLSVSVGDRVTITC

SEQ ID NO: 281 - protein, 23 aa, Artificial Sequence
  Description of Artificial Sequence: Synthetic humanized antibody 175A-huVK1 VL FR1
DVQMTQSPSSLSASVGDRATITC

SEQ ID NO: 282 - protein, 23 aa, Artificial Sequence
  Description of Artificial Sequence: Synthetic humanized antibody 175A-huVK1 VL FR1
DIQMTQSPSSLSVSVGDRATITC

SEQ ID NO: 283 - protein, 23 aa, Artificial Sequence
  Description of Artificial Sequence: Synthetic humanized antibody 175A-huVK1 VL FR1
DVQMTQSPSSLSVSVGDRATITC

SEQ ID NO: 284 - protein, 15 aa, Artificial Sequence
  Description of Artificial Sequence: Synthetic humanized antibody 175A-huVK1 VL FR2
WYQQKPGKSPKLLIY

SEQ ID NO: 285 - protein, 32 aa, Artificial Sequence
  Description of Artificial Sequence: Synthetic humanized antibody 175A-huVK1 VL FR3
GVPSRFSGSGSGTDFTLTISSVQPEDFATYYC

SEQ ID NO: 286 - protein, 32 aa, Artificial Sequence
  Description of Artificial Sequence: Synthetic humanized antibody 175A-huVK1 VL FR3
GVPSRFSGSGSGTDFTLTISSLQPEDLATYYC

SEQ ID NO: 287 - protein, 32 aa, Artificial Sequence
  Description of Artificial Sequence: Synthetic humanized antibody 175A-huVK1 VL FR3
GVPSRFSGSGSGTDFTLTISSLQPEDFGTYYC

SEQ ID NO: 288 - protein, 32 aa, Artificial Sequence
  Description of Artificial Sequence: Synthetic humanized antibody 175A-huVK1 VL FR3
GVPSRFSGSGSGTDFTLTISSVQPEDLATYYC

SEQ ID NO: 289 - protein, 32 aa, Artificial Sequence
  Description of Artificial Sequence: Synthetic humanized antibody 175A-huVK1 VL FR3
GVPSRFSGSGSGTDFTLTISSVQPEDFGTYYC

SEQ ID NO: 290 - protein, 32 aa, Artificial Sequence
  Description of Artificial Sequence: Synthetic humanized antibody 175A-huVK1 VL FR3
GVPSRFSGSGSGTDFTLTISSLQPEDLGTYYC

SEQ ID NO: 291 - protein, 32 aa, Artificial Sequence
  Description of Artificial Sequence: Synthetic humanized antibody 175A-huVK1 VL FR3
GVPSRFSGSGSGTDFTLTISSVQPEDLGTYYC

SEQ ID NO: 292 - protein, 32 aa, Artificial Sequence
  Description of Artificial Sequence: Synthetic humanized antibody 76E1-huVH1 VH FR3
RVTMTTDTSTSTAYMELRSLRSDDTAVYYCAT

SEQ ID NO: 293 - protein, 32 aa, Artificial Sequence
  Description of Artificial Sequence: Synthetic humanized antibody 76E1-huVH1 VH FR3
RATLTTDTSTSTAYMELRSLRSDDTAVYYCAR

SEQ ID NO: 294 - protein, 32 aa, Artificial Sequence
  Description of Artificial Sequence: Synthetic humanized antibody 76E1-huVH1 VH FR3
RATMTVDTSTSTAYMELRSLRSDDTAVYYCAR

SEQ ID NO: 295 - protein, 32 aa, Artificial Sequence
  Description of Artificial Sequence: Synthetic humanized antibody 76E1-huVH1 VH FR3
RATMTTDKSTSTAYMELRSLRSDDTAVYYCAR

SEQ ID NO: 296 - protein, 32 aa, Artificial Sequence
  Description of Artificial Sequence: Synthetic humanized antibody 76E1-huVH1 VH FR3
RATMTTDTSTSTAYMELRSLRSDDTAVYYCAT

SEQ ID NO: 297 - protein, 32 aa, Artificial Sequence
  Description of Artificial Sequence: Synthetic humanized antibody 76E1-huVH1 VH FR3
RVTLTVDTSTSTAYMELRSLRSDDTAVYYCAR

SEQ ID NO: 298 - protein, 32 aa, Artificial Sequence
  Description of Artificial Sequence: Synthetic humanized antibody 76E1-huVH1 VH FR3
RVTLTTDKSTSTAYMELRSLRSDDTAVYYCAR

SEQ ID NO: 299 - protein, 32 aa, Artificial Sequence
  Description of Artificial Sequence: Synthetic humanized antibody 76E1-huVH1 VH FR3
RVTLTTDTSTSTAYMELRSLRSDDTAVYYCAT

SEQ ID NO: 300 - protein, 32 aa, Artificial Sequence
  Description of Artificial Sequence: Synthetic humanized antibody 76E1-huVH1 VH FR3
RVTMTVDKSTSTAYMELRSLRSDDTAVYYCAR

SEQ ID NO: 301 - protein, 32 aa, Artificial Sequence
  Description of Artificial Sequence: Synthetic humanized antibody 76E1-huVH1 VH FR3
RVTMTVDTSTSTAYMELRSLRSDDTAVYYCAT

SEQ ID NO: 302 - protein, 32 aa, Artificial Sequence
  Description of Artificial Sequence: Synthetic humanized antibody 76E1-huVH1 VH FR3
RVTMTTDKSTSTAYMELRSLRSDDTAVYYCAT

SEQ ID NO: 303 - protein, 32 aa, Artificial Sequence
  Description of Artificial Sequence: Synthetic humanized antibody 76E1-huVH1 VH FR3
RATLTVDTSTSTAYMELRSLRSDDTAVYYCAR

SEQ ID NO: 304 - protein, 32 aa, Artificial Sequence
  Description of Artificial Sequence: Synthetic humanized antibody 76E1-huVH1 VH FR3
RATLTTDKSTSTAYMELRSLRSDDTAVYYCAR

SEQ ID NO: 305 - protein, 32 aa, Artificial Sequence
  Description of Artificial Sequence: Synthetic humanized antibody 76E1-huVH1 VH FR3
RATLTTDTSTSTAYMELRSLRSDDTAVYYCAT

SEQ ID NO: 306 - protein, 32 aa, Artificial Sequence
  Description of Artificial Sequence: Synthetic humanized antibody 76E1-huVH1 VH FR3
RATMTVDKSTSTAYMELRSLRSDDTAVYYCAR

SEQ ID NO: 307 - protein, 32 aa, Artificial Sequence
  Description of Artificial Sequence: Synthetic humanized antibody 76E1-huVH1 VH FR3
RATMTVDTSTSTAYMELRSLRSDDTAVYYCAT

SEQ ID NO: 308 - protein, 32 aa, Artificial Sequence
  Description of Artificial Sequence: Synthetic humanized antibody 76E1-huVH1 VH FR3
RATMTTDKSTSTAYMELRSLRSDDTAVYYCAT

SEQ ID NO: 309 - protein, 32 aa, Artificial Sequence
  Description of Artificial Sequence: Synthetic humanized antibody 76E1-huVH1 VH FR3
RVTLTVDKSTSTAYMELRSLRSDDTAVYYCAR

SEQ ID NO: 310 - protein, 32 aa, Artificial Sequence
  Description of Artificial Sequence: Synthetic humanized antibody 76E1-huVH1 VH FR3
RVTLTVDTSTSTAYMELRSLRSDDTAVYYCAT

SEQ ID NO: 311 - protein, 32 aa, Artificial Sequence
  Description of Artificial Sequence: Synthetic humanized antibody 76E1-huVH1 VH FR3
RVTLTTDKSTSTAYMELRSLRSDDTAVYYCAT

SEQ ID NO: 312 - protein, 32 aa, Artificial Sequence
  Description of Artificial Sequence: Synthetic humanized antibody 76E1-huVH1 VH FR3
RVTMTVDKSTSTAYMELRSLRSDDTAVYYCAT

SEQ ID NO: 313 - protein, 32 aa, Artificial Sequence
  Description of Artificial Sequence: Synthetic humanized antibody 76E1-huVH1 VH FR3
RATLTVDKSTSTAYMELRSLRSDDTAVYYCAR

SEQ ID NO: 314 - protein, 32 aa, Artificial Sequence
  Description of Artificial Sequence: Synthetic humanized antibody 76E1-huVH1 VH FR3
RATLTVDTSTSTAYMELRSLRSDDTAVYYCAT

SEQ ID NO: 315 - protein, 32 aa, Artificial Sequence
  Description of Artificial Sequence: Synthetic humanized antibody 76E1-huVH1 VH FR3
RATLTTDKSTSTAYMELRSLRSDDTAVYYCAT

SEQ ID NO: 316 - protein, 32 aa, Artificial Sequence
  Description of Artificial Sequence: Synthetic humanized antibody 76E1-huVH1 VH FR3
RATMTVDKSTSTAYMELRSLRSDDTAVYYCAT

SEQ ID NO: 317 - protein, 32 aa, Artificial Sequence
  Description of Artificial Sequence: Synthetic humanized antibody 76E1-huVH1 VH FR3
RVTLTVDKSTSTAYMELRSLRSDDTAVYYCAT

SEQ ID NO: 318 - protein, 32 aa, Artificial Sequence
  Description of Artificial Sequence: Synthetic humanized antibody 76E1-huVH1 VH FR3
RATLTVDKSTSTAYMELRSLRSDDTAVYYCAT

SEQ ID NO: 319 - protein, 9 aa, Artificial Sequence
  Description of Artificial Sequence: Synthetic humanized antibody 76E1-huVH1b VH CDR3
STLITPFDY

SEQ ID NO: 320 - protein, 11 aa, Artificial Sequence
  Description of Artificial Sequence: Synthetic humanized antibody 76E1-huVH1b VH FR4
WGQGTLLTVSS

SEQ ID NO: 321 - protein, 17 aa, Artificial Sequence
  Description of Artificial Sequence: Synthetic humanized antibody 76E1-huVH1b VH CDR2
NIDPYYDYTSYAQKLQG

SEQ ID NO: 322 - protein, 17 aa, Artificial Sequence
  Description of Artificial Sequence: Synthetic humanized antibody 76E1-huVH1b VH CDR2
NIDPYYDYTSYAQKFQG

SEQ ID NO: 323 - protein, 14 aa, Artificial Sequence
  Description of Artificial Sequence: Synthetic humanized antibody 76E1-huVH3 VH FR2
WVRQAPGKSLEWVS

SEQ ID NO: 324 - protein, 14 aa, Artificial Sequence
  Description of Artificial Sequence: Synthetic humanized antibody 76E1-huVH3 VH FR2
WVRQAPGKSLEWIS

SEQ ID NO: 325 - protein, 14 aa, Artificial Sequence
  Description of Artificial Sequence: Synthetic humanized antibody 76E1-huVH3 VH FR2
WVRQAPGKSLEWVG

SEQ ID NO: 326 - protein, 14 aa, Artificial Sequence
  Description of Artificial Sequence: Synthetic humanized antibody 76E1-huVH3 VH FR2
WVRQAPGKSLEWIG

SEQ ID NO: 327 - protein, 32 aa, Artificial Sequence; identical to SEQ ID NO: 125
  Description of Artificial Sequence: Synthetic humanized antibody 76E1-huVH3 VH FR3

SEQ ID NO: 328 - protein, 32 aa, Artificial Sequence
  Description of Artificial Sequence: Synthetic humanized antibody 76E1-huVH3 VH FR3
RFTLSRDNAKNSLYLQMNSLRAEDTAVYYCAR

SEQ ID NO: 329 - protein, 32 aa, Artificial Sequence
  Description of Artificial Sequence: Synthetic humanized antibody 76E1-huVH3 VH FR3
RFTISVDNAKNSLYLQMNSLRAEDTAVYYCAR

SEQ ID NO: 330 - protein, 32 aa, Artificial Sequence
  Description of Artificial Sequence: Synthetic humanized antibody 76E1-huVH3 VH FR3
RFTISRDKAKNSLYLQMNSLRAEDTAVYYCAR

SEQ ID NO: 331 - protein, 32 aa, Artificial Sequence
  Description of Artificial Sequence: Synthetic humanized antibody 76E1-huVH3 VH FR3
RFTISRDNAKSSLYLQMNSLRAEDTAVYYCAR

SEQ ID NO: 332 - protein, 32 aa, Artificial Sequence; identical to SEQ ID NO: 129
  Description of Artificial Sequence: Synthetic humanized antibody 76E1-huVH3 VH FR3

SEQ ID NO: 333 - protein, 32 aa, Artificial Sequence; identical to SEQ ID NO: 130
  Description of Artificial Sequence: Synthetic humanized antibody 76E1-huVH3 VH FR3

SEQ ID NO: 334 - protein, 32 aa, Artificial Sequence; identical to SEQ ID NO: 131
  Description of Artificial Sequence: Synthetic humanized antibody 76E1-huVH3 VH FR3

SEQ ID NO: 335 - protein, 32 aa, Artificial Sequence
  Description of Artificial Sequence: Synthetic humanized antibody 76E1-huVH3 VH FR3
RFTISRDNAKNSLYLQMNSLRAEDTAVYYCAT

SEQ ID NO: 336 - protein, 32 aa, Artificial Sequence
  Description of Artificial Sequence: Synthetic humanized antibody 76E1-huVH3 VH FR3
RATLSRDNAKNSLYLQMNSLRAEDTAVYYCAR

SEQ ID NO: 337 - protein, 32 aa, Artificial Sequence
  Description of Artificial Sequence: Synthetic humanized antibody 76E1-huVH3 VH FR3
RATISVDNAKNSLYLQMNSLRAEDTAVYYCAR

SEQ ID NO: 338 - protein, 32 aa, Artificial Sequence
  Description of Artificial Sequence: Synthetic humanized antibody 76E1-huVH3 VH FR3
RATISRDKAKNSLYLQMNSLRAEDTAVYYCAR

SEQ ID NO: 339 - protein, 32 aa, Artificial Sequence
  Description of Artificial Sequence: Synthetic humanized antibody 76E1-huVH3 VH FR3
RATISRDNAKSSLYLQMNSLRAEDTAVYYCAR

SEQ ID NO: 340 - protein, 32 aa, Artificial Sequence; identical to SEQ ID NO: 135
  Description of Artificial Sequence: Synthetic humanized antibody 76E1-huVH3 VH FR3

SEQ ID NO: 341 - protein, 32 aa, Artificial Sequence; identical to SEQ ID NO: 136
  Description of Artificial Sequence: Synthetic humanized antibody 76E1-huVH3 VH FR3

SEQ ID NO: 342 - protein, 32 aa, Artificial Sequence; identical to SEQ ID NO: 137
  Description of Artificial Sequence: Synthetic humanized antibody 76E1-huVH3 VH FR3

SEQ ID NO: 343 - protein, 32 aa, Artificial Sequence
  Description of Artificial Sequence: Synthetic humanized antibody 76E1-huVH3 VH FR3
RATISRDNAKNSLYLQMNSLRAEDTAVYYCAT

SEQ ID NO: 344 - protein, 32 aa, Artificial Sequence
  Description of Artificial Sequence: Synthetic humanized antibody 76E1-huVH3 VH FR3
RFTLSVDNAKNSLYLQMNSLRAEDTAVYYCAR

SEQ ID NO: 345 - protein, 32 aa, Artificial Sequence
  Description of Artificial Sequence: Synthetic humanized antibody 76E1-huVH3 VH FR3
RFTLSRDKAKNSLYLQMNSLRAEDTAVYYCAR

SEQ ID NO: 346 - protein, 32 aa, Artificial Sequence
  Description of Artificial Sequence: Synthetic humanized antibody 76E1-huVH3 VH FR3
RFTLSRDNAKSSLYLQMNSLRAEDTAVYYCAR

SEQ ID NO: 347 - protein, 32 aa, Artificial Sequence
  Description of Artificial Sequence: Synthetic humanized antibody 76E1-huVH3 VH FR3
RFTLSRDNAKNSAYLQMNSLRAEDTAVYYCAR

SEQ ID NO: 348 - protein, 32 aa, Artificial Sequence
  Description of Artificial Sequence: Synthetic humanized antibody 76E1-huVH3 VH FR3
RFTLSRDNAKNSLYMQMNSLRAEDTAVYYCAR

SEQ ID NO: 349 - protein, 32 aa, Artificial Sequence
  Description of Artificial Sequence: Synthetic humanized antibody 76E1-huVH3 VH FR3
RFTLSRDNAKNSLYLQLNSLRAEDTAVYYCAR

SEQ ID NO: 350 - protein, 32 aa, Artificial Sequence
  Description of Artificial Sequence: Synthetic humanized antibody 76E1-huVH3 VH FR3
RFTLSRDNAKNSLYLQMNSLRAEDTAVYYCAT

SEQ ID NO: 351 - protein, 32 aa, Artificial Sequence
  Description of Artificial Sequence: Synthetic humanized antibody 76E1-huVH3 VH FR3
RFTISVDKAKNSLYLQMNSLRAEDTAVYYCAR

SEQ ID NO: 352 - protein, 32 aa, Artificial Sequence
  Description of Artificial Sequence: Synthetic humanized antibody 76E1-huVH3 VH FR3
RFTISVDNAKSSLYLQMNSLRAEDTAVYYCAR

SEQ ID NO: 353 - protein, 32 aa, Artificial Sequence
  Description of Artificial Sequence: Synthetic humanized antibody 76E1-huVH3 VH FR3
RFTISVDNAKNSAYLQMNSLRAEDTAVYYCAR

SEQ ID NO: 354 - protein, 32 aa, Artificial Sequence
  Description of Artificial Sequence: Synthetic humanized antibody 76E1-huVH3 VH FR3
RFTISVDNAKNSLYMQMNSLRAEDTAVYYCAR

SEQ ID NO: 355 - protein, 32 aa, Artificial Sequence
  Description of Artificial Sequence: Synthetic humanized antibody 76E1-huVH3 VH FR3
RFTISVDNAKNSLYLQLNSLRAEDTAVYYCAR

SEQ ID NO: 356 - protein, 32 aa, Artificial Sequence
  Description of Artificial Sequence: Synthetic humanized antibody 76E1-huVH3 VH FR3
RFTISVDNAKNSLYLQMNSLRAEDTAVYYCAT

SEQ ID NO: 357 - protein, 32 aa, Artificial Sequence
  Description of Artificial Sequence: Synthetic humanized antibody 76E1-huVH3 VH FR3
RFTISRDKAKSSLYLQMNSLRAEDTAVYYCAR

SEQ ID NO: 358 - protein, 32 aa, Artificial Sequence
  Description of Artificial Sequence: Synthetic humanized antibody 76E1-huVH3 VH FR3
RFTISRDKAKNSAYLQMNSLRAEDTAVYYCAR

SEQ ID NO: 359 - protein, 32 aa, Artificial Sequence
  Description of Artificial Sequence: Synthetic humanized antibody 76E1-huVH3 VH FR3
RFTISRDKAKNSLYMQMNSLRAEDTAVYYCAR

SEQ ID NO: 360 - protein, 32 aa, Artificial Sequence
  Description of Artificial Sequence: Synthetic humanized antibody 76E1-huVH3 VH FR3
RFTISRDKAKNSLYLQLNSLRAEDTAVYYCAR

SEQ ID NO: 361 - protein, 32 aa, Artificial Sequence
  Description of Artificial Sequence: Synthetic humanized antibody 76E1-huVH3 VH FR3
RFTISRDKAKNSLYLQMNSLRAEDTAVYYCAT

SEQ ID NO: 362 - protein, 32 aa, Artificial Sequence
  Description of Artificial Sequence: Synthetic humanized antibody 76E1-huVH3 VH FR3
RFTISRDNAKSSAYLQMNSLRAEDTAVYYCAR

SEQ ID NO: 363 - protein, 32 aa, Artificial Sequence
  Description of Artificial Sequence: Synthetic humanized antibody 76E1-huVH3 VH FR3
RFTISRDNAKSSLYMQMNSLRAEDTAVYYCAR

SEQ ID NO: 364 - protein, 32 aa, Artificial Sequence
  Description of Artificial Sequence: Synthetic humanized antibody 76E1-huVH3 VH FR3
RFTISRDNAKSSLYLQLNSLRAEDTAVYYCAR

SEQ ID NO: 365 - protein, 32 aa, Artificial Sequence
  Description of Artificial Sequence: Synthetic humanized antibody 76E1-huVH3 VH FR3
RFTISRDNAKSSLYLQMNSLRAEDTAVYYCAT

SEQ ID NO: 366 - protein, 32 aa, Artificial Sequence; identical to SEQ ID NO: 150
  Description of Artificial Sequence: Synthetic humanized antibody 76E1-huVH3 VH FR3

SEQ ID NO: 367 - protein, 32 aa, Artificial Sequence; identical to SEQ ID NO: 151
  Description of Artificial Sequence: Synthetic humanized antibody 76E1-huVH3 VH FR3

SEQ ID NO: 368 - protein, 32 aa, Artificial Sequence
  Description of Artificial Sequence: Synthetic humanized antibody 76E1-huVH3 VH FR3
RFTISRDNAKNSAYLQMNSLRAEDTAVYYCAT

SEQ ID NO: 369 - protein, 32 aa, Artificial Sequence; identical to SEQ ID NO: 152
  Description of Artificial Sequence: Synthetic humanized antibody 76E1-huVH3 VH FR3

SEQ ID NO: 370 - protein, 32 aa, Artificial Sequence
  Description of Artificial Sequence: Synthetic humanized antibody 76E1-huVH3 VH FR3
RFTISRDNAKNSLYMQMNSLRAEDTAVYYCAT

SEQ ID NO: 371 - protein, 32 aa, Artificial Sequence
  Description of Artificial Sequence: Synthetic humanized antibody 76E1-huVH3 VH FR3
RFTISRDNAKNSLYLQLNSLRAEDTAVYYCAT

SEQ ID NO: 372 - protein, 32 aa, Artificial Sequence
  Description of Artificial Sequence: Synthetic humanized antibody 76E1-huVH3 VH FR3
RATLSVDNAKNSLYLQMNSLRAEDTAVYYCAR

SEQ ID NO: 373 - protein, 32 aa, Artificial Sequence
  Description of Artificial Sequence: Synthetic humanized antibody 76E1-huVH3 VH FR3
RATLSRDKAKNSLYLQMNSLRAEDTAVYYCAR

SEQ ID NO: 374 - protein, 32 aa, Artificial Sequence
  Description of Artificial Sequence: Synthetic humanized antibody 76E1-huVH3 VH FR3
RATLSRDNAKSSLYLQMNSLRAEDTAVYYCAR

SEQ ID NO: 375 - protein, 32 aa, Artificial Sequence
  Description of Artificial Sequence: Synthetic humanized antibody 76E1-huVH3 VH FR3
RATLSRDNAKNSAYLQMNSLRAEDTAVYYCAR

SEQ ID NO: 376 - protein, 32 aa, Artificial Sequence
  Description of Artificial Sequence: Synthetic humanized antibody 76E1-huVH3 VH FR3
RATLSRDNAKNSLYMQMNSLRAEDTAVYYCAR

SEQ ID NO: 377 - protein, 32 aa, Artificial Sequence
  Description of Artificial Sequence: Synthetic humanized antibody 76E1-huVH3 VH FR3
RATLSRDNAKNSLYLQLNSLRAEDTAVYYCAR

SEQ ID NO: 378 - protein, 32 aa, Artificial Sequence
  Description of Artificial Sequence: Synthetic humanized antibody 76E1-huVH3 VH FR3
RATLSRDNAKNSLYLQMNSLRAEDTAVYYCAT

SEQ ID NO: 379 - protein, 32 aa, Artificial Sequence
  Description of Artificial Sequence: Synthetic humanized antibody 76E1-huVH3 VH FR3
RATISVDKAKNSLYLQMNSLRAEDTAVYYCAR

SEQ ID NO: 380 - protein, 32 aa, Artificial Sequence
  Description of Artificial Sequence: Synthetic humanized antibody 76E1-huVH3 VH FR3
RATISVDNAKSSLYLQMNSLRAEDTAVYYCAR

SEQ ID NO: 381 - protein, 32 aa, Artificial Sequence
  Description of Artificial Sequence: Synthetic humanized antibody 76E1-huVH3 VH FR3
RATISVDNAKNSAYLQMNSLRAEDTAVYYCAR

SEQ ID NO: 382 - protein, 32 aa, Artificial Sequence
  Description of Artificial Sequence: Synthetic humanized antibody 76E1-huVH3 VH FR3
RATISVDNAKNSLYMQMNSLRAEDTAVYYCAR

SEQ ID NO: 383 - protein, 32 aa, Artificial Sequence
  Description of Artificial Sequence: Synthetic humanized antibody 76E1-huVH3 VH FR3
RATISVDNAKNSLYLQLNSLRAEDTAVYYCAR

SEQ ID NO: 384 - protein, 32 aa, Artificial Sequence
  Description of Artificial Sequence: Synthetic humanized antibody 76E1-huVH3 VH FR3
RATISVDNAKNSLYLQMNSLRAEDTAVYYCAT

SEQ ID NO: 385 - protein, 32 aa, Artificial Sequence
  Description of Artificial Sequence: Synthetic humanized antibody 76E1-huVH3 VH FR3
RATISRDKAKSSLYLQMNSLRAEDTAVYYCAR

SEQ ID NO: 386 - protein, 32 aa, Artificial Sequence
  Description of Artificial Sequence: Synthetic humanized antibody 76E1-huVH3 VH FR3
RATISRDKAKNSAYLQMNSLRAEDTAVYYCAR

SEQ ID NO: 387 - protein, 32 aa, Artificial Sequence
  Description of Artificial Sequence: Synthetic humanized antibody 76E1-huVH3 VH FR3
RATISRDKAKNSLYMQMNSLRAEDTAVYYCAR

SEQ ID NO: 388 - protein, 32 aa, Artificial Sequence
  Description of Artificial Sequence: Synthetic humanized antibody 76E1-huVH3 VH FR3
RATISRDKAKNSLYLQLNSLRAEDTAVYYCAR

SEQ ID NO: 389 - protein, 32 aa, Artificial Sequence
  Description of Artificial Sequence: Synthetic humanized antibody 76E1-huVH3 VH FR3
RATISRDKAKNSLYLQMNSLRAEDTAVYYCAT

SEQ ID NO: 390 - protein, 32 aa, Artificial Sequence
  Description of Artificial Sequence: Synthetic humanized antibody 76E1-huVH3 VH FR3
RATISRDNAKSSAYLQMNSLRAEDTAVYYCAR

SEQ ID NO: 391 - protein, 32 aa, Artificial Sequence
  Description of Artificial Sequence: Synthetic humanized antibody 76E1-huVH3 VH FR3
RATISRDNAKSSLYMQMNSLRAEDTAVYYCAR

SEQ ID NO: 392 - protein, 32 aa, Artificial Sequence
  Description of Artificial Sequence: Synthetic humanized antibody 76E1-huVH3 VH FR3
RATISRDNAKSSLYLQLNSLRAEDTAVYYCAR

SEQ ID NO: 393 - protein, 32 aa, Artificial Sequence
  Description of Artificial Sequence: Synthetic humanized antibody 76E1-huVH3 VH FR3
RATISRDNAKSSLYLQMNSLRAEDTAVYYCAT

SEQ ID NO: 394 - protein, 32 aa, Artificial Sequence; identical to SEQ ID NO: 165
  Description of Artificial Sequence: Synthetic humanized antibody 76E1-huVH3 VH FR3

SEQ ID NO: 395 - protein, 32 aa, Artificial Sequence; identical to SEQ ID NO: 166
  Description of Artificial Sequence: Synthetic humanized antibody 76E1-huVH3 VH FR3

SEQ ID NO: 396 - protein, 32 aa, Artificial Sequence
  Description of Artificial Sequence: Synthetic humanized antibody 76E1-huVH3 VH FR3
RATISRDNAKNSAYLQMNSLRAEDTAVYYCAT

SEQ ID NO: 397 - protein, 32 aa, Artificial Sequence; identical to SEQ ID NO: 167
  Description of Artificial Sequence: Synthetic humanized antibody 76E1-huVH3 VH FR3

SEQ ID NO: 398 - protein, 32 aa, Artificial Sequence
  Description of Artificial Sequence: Synthetic humanized antibody 76E1-huVH3 VH FR3
RATISRDNAKNSLYMQMNSLRAEDTAVYYCAT

SEQ ID NO: 399 - protein, 32 aa, Artificial Sequence
  Description of Artificial Sequence: Synthetic humanized antibody 76E1-huVH3 VH FR3
RATISRDNAKNSLYLQLNSLRAEDTAVYYCAT

SEQ ID NO: 400 - protein, 32 aa, Artificial Sequence
  Description of Artificial Sequence: Synthetic humanized antibody 76E1-huVH3 VH FR3
RFTLSVDKAKNSLYLQMNSLRAEDTAVYYCAR

SEQ ID NO: 401 - protein, 32 aa, Artificial Sequence
  Description of Artificial Sequence: Synthetic humanized antibody 76E1-huVH3 VH FR3
RFTLSVDNAKSSLYLQMNSLRAEDTAVYYCAR

SEQ ID NO: 402 - protein, 32 aa, Artificial Sequence
  Description of Artificial Sequence: Synthetic humanized antibody 76E1-huVH3 VH FR3
RFTLSVDNAKNSAYLQMNSLRAEDTAVYYCAR

SEQ ID NO: 403 - protein, 32 aa, Artificial Sequence
  Description of Artificial Sequence: Synthetic humanized antibody 76E1-huVH3 VH FR3
RFTLSVDNAKNSLYMQMNSLRAEDTAVYYCAR

SEQ ID NO: 404 - protein, 32 aa, Artificial Sequence
  Description of Artificial Sequence: Synthetic humanized antibody 76E1-huVH3 VH FR3
RFTLSVDNAKNSLYLQLNSLRAEDTAVYYCAR

SEQ ID NO: 405 - protein, 32 aa, Artificial Sequence
  Description of Artificial Sequence: Synthetic humanized antibody 76E1-huVH3 VH FR3
RFTLSVDNAKNSLYLQMNSLRAEDTAVYYCAT

SEQ ID NO: 406 - protein, 32 aa, Artificial Sequence
  Description of Artificial Sequence: Synthetic humanized antibody 76E1-huVH3 VH FR3
RFTLSRDKASNSLYLQMNSLRAEDTAVYYCAR

SEQ ID NO: 407 - protein, 32 aa, Artificial Sequence
  Description of Artificial Sequence: Synthetic humanized antibody 76E1-huVH3 VH FR3
RFTLSRDKAKNSAYLQMNSLRAEDTAVYYCAR

SEQ ID NO: 408 - protein, 32 aa, Artificial Sequence
  Description of Artificial Sequence: Synthetic humanized antibody 76E1-huVH3 VH FR3
RFTLSRDKAKNSLYMQMNSLRAEDTAVYYCAR

SEQ ID NO: 409 - protein, 32 aa, Artificial Sequence
  Description of Artificial Sequence: Synthetic humanized antibody 76E1-huVH3 VH FR3
RFTLSRDKAKNSLYLQLNSLRAEDTAVYYCAR

SEQ ID NO: 410 - protein, 32 aa, Artificial Sequence
  Description of Artificial Sequence: Synthetic humanized antibody 76E1-huVH3 VH FR3
RFTLSRDKAKNSLYLQMNSLRAEDTAVYYCAT

SEQ ID NO: 411 - protein, 32 aa, Artificial Sequence
  Description of Artificial Sequence: Synthetic humanized antibody 76E1-huVH3 VH FR3
RFTLSRDNAKSSAYLQMNSLRAEDTAVYYCAR

SEQ ID NO: 412 - protein, 32 aa, Artificial Sequence
  Description of Artificial Sequence: Synthetic humanized antibody 76E1-huVH3 VH FR3
RFTLSRDNAKSSLYMQMNSLRAEDTAVYYCAR

SEQ ID NO: 413 - protein, 32 aa, Artificial Sequence
  Description of Artificial Sequence: Synthetic humanized antibody 76E1-huVH3 VH FR3
RFTLSRDNAKSSLYLQLNSLRAEDTAVYYCAR

SEQ ID NO: 414 - protein, 32 aa, Artificial Sequence
  Description of Artificial Sequence: Synthetic humanized antibody 76E1-huVH3 VH FR3
RFTLSRDNAKSSLYLQMNSLRAEDTAVYYCAT

SEQ ID NO: 415 - protein, 32 aa, Artificial Sequence
  Description of Artificial Sequence: Synthetic humanized antibody 76E1-huVH3 VH FR3
RFTLSRDNAKNSAYMQMNSLRAEDTAVYYCAR

SEQ ID NO: 416 - protein, 32 aa, Artificial Sequence
  Description of Artificial Sequence: Synthetic humanized antibody 76E1-huVH3 VH FR3
RFTLSRDNAKNSAYLQLNSLRAEDTAVYYCAR

SEQ ID NO: 417 - protein, 32 aa, Artificial Sequence
  Description of Artificial Sequence: Synthetic humanized antibody 76E1-huVH3 VH FR3
RFTLSRDNAKNSAYLQMNSLRAEDTAVYYCAT

SEQ ID NO: 418 - protein, 32 aa, Artificial Sequence
  Description of Artificial Sequence: Synthetic humanized antibody 76E1-huVH3 VH FR3
RFTLSRDNAKNSLYMQLNSLRAEDTAVYYCAR

SEQ ID NO: 419 - protein, 32 aa, Artificial Sequence
  Description of Artificial Sequence: Synthetic humanized antibody 76E1-huVH3 VH FR3
RFTLSRDNAKNSLYMQMNSLRAEDTAVYYCAT

SEQ ID NO: 420 - protein, 32 aa, Artificial Sequence
  Description of Artificial Sequence: Synthetic humanized antibody 76E1-huVH3 VH FR3
RFTLSRDNAKNSLYLQLNSLRAEDTAVYYCAT

SEQ ID NO: 421 - protein, 32 aa, Artificial Sequence
  Description of Artificial Sequence: Synthetic humanized antibody 76E1-huVH3 VH FR3
RFTISVDKAKSSLYLQMNSLRAEDTAVYYCAR

SEQ ID NO: 422 - protein, 32 aa, Artificial Sequence
  Description of Artificial Sequence: Synthetic humanized antibody 76E1-huVH3 VH FR3
RFTISVDKAKNSAYLQMNSLRAEDTAVYYCAR

SEQ ID NO: 423 - protein, 32 aa, Artificial Sequence
  Description of Artificial Sequence: Synthetic humanized antibody 76E1-huVH3 VH FR3
RFTISVDKAKNSLYMQMNSLRAEDTAVYYCAR

SEQ ID NO: 424 - protein, 32 aa, Artificial Sequence
  Description of Artificial Sequence: Synthetic humanized antibody 76E1-huVH3 VH FR3
RFTISVDKAKNSLYLQLNSLRAEDTAVYYCAR

SEQ ID NO: 425 - protein, 32 aa, Artificial Sequence
  Description of Artificial Sequence: Synthetic humanized antibody 76E1-huVH3 VH FR3
RFTISVDKAKNSLYLQMNSLRAEDTAVYYCAT

SEQ ID NO: 426 - protein, 32 aa, Artificial Sequence
  Description of Artificial Sequence: Synthetic humanized antibody 76E1-huVH3 VH FR3
RFTISVDNAKSSAYLQMNSLRAEDTAVYYCAR

SEQ ID NO: 427 - protein, 32 aa, Artificial Sequence
  Description of Artificial Sequence: Synthetic humanized antibody 76E1-huVH3 VH FR3
RFTISVDNAKSSLYMQMNSLRAEDTAVYYCAR

SEQ ID NO: 428 - protein, 32 aa, Artificial Sequence
  Description of Artificial Sequence: Synthetic humanized antibody 76E1-huVH3 VH FR3
RFTISVDNAKSSLYLQLNSLRAEDTAVYYCAR

SEQ ID NO: 429 - protein, 32 aa, Artificial Sequence
  Description of Artificial Sequence: Synthetic humanized antibody 76E1-huVH3 VH FR3
RFTISVDNAKSSLYLQMNSLRAEDTAVYYCAT

SEQ ID NO: 430 - protein, 32 aa, Artificial Sequence
  Description of Artificial Sequence: Synthetic humanized antibody 76E1-huVH3 VH FR3
RFTISVDNAKNSAYMQMNSLRAEDTAVYYCAR

SEQ ID NO: 431 - protein, 32 aa, Artificial Sequence
  Description of Artificial Sequence: Synthetic humanized antibody 76E1-huVH3 VH FR3
RFTISVDNAKNSAYLQLNSLRAEDTAVYYCAR

SEQ ID NO: 432 - protein, 32 aa, Artificial Sequence
  Description of Artificial Sequence: Synthetic humanized antibody 76E1-huVH3 VH FR3
RFTISVDNAKNSAYLQMNSLRAEDTAVYYCAT

SEQ ID NO: 433 - protein, 32 aa, Artificial Sequence
  Description of Artificial Sequence: Synthetic humanized antibody 76E1-huVH3 VH FR3
RFTISVDNAKNSLYMQLNSLRAEDTAVYYCAR

SEQ ID NO: 434 - protein, 32 aa, Artificial Sequence
  Description of Artificial Sequence: Synthetic humanized antibody 76E1-huVH3 VH FR3
RFTISVDNAKNSLYMQMNSLRAEDTAVYYCAT

SEQ ID NO: 435 - protein, 32 aa, Artificial Sequence
  Description of Artificial Sequence: Synthetic humanized antibody 76E1-huVH3 VH FR3
RFTISVDNAKNSLYLQLNSLRAEDTAVYYCAT

SEQ ID NO: 436 - protein, 32 aa, Artificial Sequence
  Description of Artificial Sequence: Synthetic humanized antibody 76E1-huVH3 VH FR3
RFTISRDKAKSSAYLQMNSLRAEDTAVYYCAR

SEQ ID NO: 437 - protein, 32 aa, Artificial Sequence
  Description of Artificial Sequence: Synthetic humanized antibody 76E1-huVH3 VH FR3
RFTISRDKAKSSLYMQMNSLRAEDTAVYYCAR

SEQ ID NO: 438 - protein, 32 aa, Artificial Sequence
  Description of Artificial Sequence: Synthetic humanized antibody 76E1-huVH3 VH FR3
RFTISRDKAKSSLYLQLNSLRAEDTAVYYCAR

SEQ ID NO: 439 - protein, 32 aa, Artificial Sequence
  Description of Artificial Sequence: Synthetic humanized antibody 76E1-huVH3 VH FR3
RFTISRDKAKSSLYLQMNSLRAEDTAVYYCAT

SEQ ID NO: 440 - protein, 32 aa, Artificial Sequence
  Description of Artificial Sequence: Synthetic humanized antibody 76E1-huVH3 VH FR3
RFTISRDKAKNSAYMQMNSLRAEDTAVYYCAR

SEQ ID NO: 441 - protein, 32 aa, Artificial Sequence
  Description of Artificial Sequence: Synthetic humanized antibody 76E1-huVH3 VH FR3
RFTISRDKAKNSAYLQLNSLRAEDTAVYYCAR

SEQ ID NO: 442 - protein, 32 aa, Artificial Sequence
  Description of Artificial Sequence: Synthetic humanized antibody 76E1-huVH3 VH FR3
RFTISRDKAKNSAYLQMNSLRAEDTAVYYCAT

SEQ ID NO: 443 - protein, 32 aa, Artificial Sequence
  Description of Artificial Sequence: Synthetic humanized antibody 76E1-huVH3 VH FR3
RFTISRDKAKNSLYMQLNSLRAEDTAVYYCAR

SEQ ID NO: 444 - protein, 32 aa, Artificial Sequence
  Description of Artificial Sequence: Synthetic humanized antibody 76E1-huVH3 VH FR3
RFTISRDKAKNSLYMQMNSLRAEDTAVYYCAT

SEQ ID NO: 445 - protein, 32 aa, Artificial Sequence
  Description of Artificial Sequence: Synthetic humanized antibody 76E1-huVH3 VH FR3
RFTISRDKAKNSLYLQLNSLRAEDTAVYYCAT

SEQ ID NO: 446 - protein, 32 aa, Artificial Sequence
  Description of Artificial Sequence: Synthetic humanized antibody 76E1-huVH3 VH FR3
RFTISRDNAKSSAYMQMNSLRAEDTAVYYCAR

SEQ ID NO: 447 - protein, 32 aa, Artificial Sequence
  Description of Artificial Sequence: Synthetic humanized antibody 76E1-huVH3 VH FR3
RFTISRDNAKSSAYLQLNSLRAEDTAVYYCAR

SEQ ID NO: 448 - protein, 32 aa, Artificial Sequence
  Description of Artificial Sequence: Synthetic humanized antibody 76E1-huVH3 VH FR3
RFTISRDNAKSSAYLQMNSLRAEDTAVYYCAT

SEQ ID NO: 449 - protein, 32 aa, Artificial Sequence
  Description of Artificial Sequence: Synthetic humanized antibody 76E1-huVH3 VH FR3
RFTISRDNAKSSLYMQLNSLRAEDTAVYYCAR

SEQ ID NO: 450 - protein, 32 aa, Artificial Sequence
  Description of Artificial Sequence: Synthetic humanized antibody 76E1-huVH3 VH FR3
RFTISRDNAKSSLYMQMNSLRAEDTAVYYCAT

SEQ ID NO: 451 - protein, 32 aa, Artificial Sequence
  Description of Artificial Sequence: Synthetic humanized antibody 76E1-huVH3 VH FR3
RFTISRDNAKSSLYLQLNSLRAEDTAVYYCAT

SEQ ID NO: 452 - protein, 32 aa, Artificial Sequence; identical to SEQ ID NO: 187
  Description of Artificial Sequence: Synthetic humanized antibody 76E1-huVH3 VH FR3

SEQ ID NO: 453 - protein, 32 aa, Artificial Sequence
  Description of Artificial Sequence: Synthetic humanized antibody 76E1-huVH3 VH FR3
RFTISRDNAKNSAYMQMNSLRAEDTAVYYCAT

SEQ ID NO: 454 - protein, 32 aa, Artificial Sequence
  Description of Artificial Sequence: Synthetic humanized antibody 76E1-huVH3 VH FR3
RFTISRDNAKNSAYLQLNSLRAEDTAVYYCAT

SEQ ID NO: 455 - protein, 32 aa, Artificial Sequence
  Description of Artificial Sequence: Synthetic humanized antibody 76E1-huVH3 VH FR3
RFTISRDNAKNSLYMQLNSLRAEDTAVYYCAT

SEQ ID NO: 456 - protein, 32 aa, Artificial Sequence
  Description of Artificial Sequence: Synthetic humanized antibody 76E1-huVH3 VH FR3
RATLSVDKAKNSLYLQMNSLRAEDTAVYYCAR

SEQ ID NO: 457 - protein, 32 aa, Artificial Sequence
  Description of Artificial Sequence: Synthetic humanized antibody 76E1-huVH3 VH FR3
RATLSVDNAKSSLYLQMNSLRAEDTAVYYCAR

SEQ ID NO: 458 - protein, 32 aa, Artificial Sequence
  Description of Artificial Sequence: Synthetic humanized antibody 76E1-huVH3 VH FR3
RATLSVDNAKNSAYLQMNSLRAEDTAVYYCAR

SEQ ID NO: 459 - protein, 32 aa, Artificial Sequence
  Description of Artificial Sequence: Synthetic humanized antibody 76E1-huVH3 VH FR3
RATLSVDNAKNSLYMQMNSLRAEDTAVYYCAR

SEQ ID NO: 460 - protein, 32 aa, Artificial Sequence
  Description of Artificial Sequence: Synthetic humanized antibody 76E1-huVH3 VH FR3
RATLSVDNAKNSLYLQLNSLRAEDTAVYYCAR

SEQ ID NO: 461 - protein, 32 aa, Artificial Sequence
  Description of Artificial Sequence: Synthetic humanized antibody 76E1-huVH3 VH FR3
RATLSVDNAKNSLYLQMNSLRAEDTAVYYCAT

SEQ ID NO: 462 - protein, 32 aa, Artificial Sequence
  Description of Artificial Sequence: Synthetic humanized antibody 76E1-huVH3 VH FR3
RATLSRDKAKSSLYLQMNSLRAEDTAVYYCAR

SEQ ID NO: 463 - protein, 32 aa, Artificial Sequence
  Description of Artificial Sequence: Synthetic humanized antibody 76E1-huVH3 VH FR3
RATLSRDKAKNSAYLQMNSLRAEDTAVYYCAR

SEQ ID NO: 464 - protein, 32 aa, Artificial Sequence
  Description of Artificial Sequence: Synthetic humanized antibody 76E1-huVH3 VH FR3
RATLSRDKAKNSLYMQMNSLRAEDTAVYYCAR

SEQ ID NO: 465 - protein, 32 aa, Artificial Sequence
  Description of Artificial Sequence: Synthetic humanized antibody 76E1-huVH3 VH FR3
RATLSRDKAKNSLYLQLNSLRAEDTAVYYCAR

SEQ ID NO: 466 - protein, 32 aa, Artificial Sequence
  Description of Artificial Sequence: Synthetic humanized antibody 76E1-huVH3 VH FR3
RATLSRDKAKNSLYLQMNSLRAEDTAVYYCAT

SEQ ID NO: 467 - protein, 32 aa, Artificial Sequence
  Description of Artificial Sequence: Synthetic humanized antibody 76E1-huVH3 VH FR3
RATLSRDNAKSSAYLQMNSLRAEDTAVYYCAR

SEQ ID NO: 468 - protein, 32 aa, Artificial Sequence
  Description of Artificial Sequence: Synthetic humanized antibody 76E1-huVH3 VH FR3
RATLSRDNAKSSLYMQMNSLRAEDTAVYYCAR

SEQ ID NO: 469 - protein, 32 aa, Artificial Sequence
  Description of Artificial Sequence: Synthetic humanized antibody 76E1-huVH3 VH FR3
RATLSRDNAKSSLYLQLNSLRAEDTAVYYCAR

SEQ ID NO: 470 - protein, 32 aa, Artificial Sequence
  Description of Artificial Sequence: Synthetic humanized antibody 76E1-huVH3 VH FR3
RATLSRDNAKSSLYLQMNSLRAEDTAVYYCAT

SEQ ID NO: 471 - protein, 32 aa, Artificial Sequence
  Description of Artificial Sequence: Synthetic humanized antibody 76E1-huVH3 VH FR3
RATLSRDNAKNSAYMQMNSLRAEDTAVYYCAR

SEQ ID NO: 472 - protein, 32 aa, Artificial Sequence
  Description of Artificial Sequence: Synthetic humanized antibody 76E1-huVH3 VH FR3
RATLSRDNAKNSAYLQLNSLRAEDTAVYYCAR

SEQ ID NO: 473 - protein, 32 aa, Artificial Sequence
  Description of Artificial Sequence: Synthetic humanized antibody 76E1-huVH3 VH FR3
RATLSRDNAKNSAYLQMNSLRAEDTAVYYCAT

SEQ ID NO: 474 - protein, 32 aa, Artificial Sequence
  Description of Artificial Sequence: Synthetic humanized antibody 76E1-huVH3 VH FR3
RATLSRDNAKNSLYMQLNSLRAEDTAVYYCAR

SEQ ID NO: 475 - protein, 32 aa, Artificial Sequence
  Description of Artificial Sequence: Synthetic humanized antibody 76E1-huVH3 VH FR3
RATLSRDNAKNSLYMQMNSLRAEDTAVYYCAT

SEQ ID NO: 476 - protein, 32 aa, Artificial Sequence
  Description of Artificial Sequence: Synthetic humanized antibody 76E1-huVH3 VH FR3
RATLSRDNAKNSLYLQLNSLRAEDTAVYYCAT

SEQ ID NO: 477 - protein, 32 aa, Artificial Sequence
  Description of Artificial Sequence: Synthetic humanized antibody 76E1-huVH3 VH FR3
RATISVDKAKSSLYLQMNSLRAEDTAVYYCAR

SEQ ID NO: 478 - protein, 32 aa, Artificial Sequence
  Description of Artificial Sequence: Synthetic humanized antibody 76E1-huVH3 VH FR3
RATISVDKAKNSAYLQMNSLRAEDTAVYYCAR

SEQ ID NO: 479 - protein, 32 aa, Artificial Sequence
  Description of Artificial Sequence: Synthetic humanized antibody 76E1-huVH3 VH FR3
RATISVDKAKNSLYMQMNSLRAEDTAVYYCAR

SEQ ID NO: 480 - protein, 32 aa, Artificial Sequence
  Description of Artificial Sequence: Synthetic humanized antibody 76E1-huVH3 VH FR3
RATISVDKAKNSLYLQLNSLRAEDTAVYYCAR

SEQ ID NO: 481 - protein, 32 aa, Artificial Sequence
  Description of Artificial Sequence: Synthetic humanized antibody 76E1-huVH3 VH FR3
RATISVDKAKNSLYLQMNSLRAEDTAVYYCAT

SEQ ID NO: 482 - protein, 32 aa, Artificial Sequence
  Description of Artificial Sequence: Synthetic humanized antibody 76E1-huVH3 VH FR3
RATISVDNAKSSAYLQMNSLRAEDTAVYYCAR

SEQ ID NO: 483 - protein, 32 aa, Artificial Sequence
  Description of Artificial Sequence: Synthetic humanized antibody 76E1-huVH3 VH FR3
RATISVDNAKSSLYMQMNSLRAEDTAVYYCAR

SEQ ID NO: 484 - protein, 32 aa, Artificial Sequence
  Description of Artificial Sequence: Synthetic humanized antibody 76E1-huVH3 VH FR3
RATISVDNAKSSLYLQLNSLRAEDTAVYYCAR

SEQ ID NO: 485 - protein, 32 aa, Artificial Sequence
  Description of Artificial Sequence: Synthetic humanized antibody 76E1-huVH3 VH FR3
RATISVDNAKSSLYLQMNSLRAEDTAVYYCAT

SEQ ID NO: 486 - protein, 32 aa, Artificial Sequence
  Description of Artificial Sequence: Synthetic humanized antibody 76E1-huVH3 VH FR3
RATISVDNAKNSAYMQMNSLRAEDTAVYYCAR

SEQ ID NO: 487 - protein, 32 aa, Artificial Sequence
  Description of Artificial Sequence: Synthetic humanized antibody 76E1-huVH3 VH FR3
RATISVDNAKNSAYLQLNSLRAEDTAVYYCAR

SEQ ID NO: 488 - protein, 32 aa, Artificial Sequence
  Description of Artificial Sequence: Synthetic humanized antibody 76E1-huVH3 VH FR3
RATISVDNAKNSAYLQMNSLRAEDTAVYYCAT

SEQ ID NO: 489 - protein, 32 aa, Artificial Sequence
  Description of Artificial Sequence: Synthetic humanized antibody 76E1-huVH3 VH FR3
RATISVDNAKNSLYMQLNSLRAEDTAVYYCAR

SEQ ID NO: 490 - protein, 32 aa, Artificial Sequence
  Description of Artificial Sequence: Synthetic humanized antibody 76E1-huVH3 VH FR3
RATISVDNAKNSLYMQMNSLRAEDTAVYYCAT

SEQ ID NO: 491 - protein, 32 aa, Artificial Sequence
  Description of Artificial Sequence: Synthetic humanized antibody 76E1-huVH3 VH FR3
RATISVDNAKNSLYLQLNSLRAEDTAVYYCAT

SEQ ID NO: 492 - protein, 32 aa, Artificial Sequence
  Description of Artificial Sequence: Synthetic humanized antibody 76E1-huVH3 VH FR3
RATISRDKAKSSAYLQMNSLRAEDTAVYYCAR

SEQ ID NO: 493 - protein, 32 aa, Artificial Sequence
  Description of Artificial Sequence: Synthetic humanized antibody 76E1-huVH3 VH FR3
RATISRDKAKSSLYMQMNSLRAEDTAVYYCAR

SEQ ID NO: 494 - protein, 32 aa, Artificial Sequence
  Description of Artificial Sequence: Synthetic humanized antibody 76E1-huVH3 VH FR3
RATISRDKAKSSLYLQLNSLRAEDTAVYYCAR

SEQ ID NO: 495 - protein, 32 aa, Artificial Sequence
  Description of Artificial Sequence: Synthetic humanized antibody 76E1-huVH3 VH FR3
RATISRDKAKSSLYLQMNSLRAEDTAVYYCAT

SEQ ID NO: 496 - protein, 32 aa, Artificial Sequence
  Description of Artificial Sequence: Synthetic humanized antibody 76E1-huVH3 VH FR3
RATISRDKAKNSAYMQMNSLRAEDTAVYYCAR

SEQ ID NO: 497 - protein, 32 aa, Artificial Sequence
  Description of Artificial Sequence: Synthetic humanized antibody 76E1-huVH3 VH FR3
RATISRDKAKNSAYLQLNSLRAEDTAVYYCAR

SEQ ID NO: 498 - protein, 32 aa, Artificial Sequence
  Description of Artificial Sequence: Synthetic humanized antibody 76E1-huVH3 VH FR3
RATISRDKAKNSAYLQMNSLRAEDTAVYYCAT

SEQ ID NO: 499 - protein, 32 aa, Artificial Sequence
  Description of Artificial Sequence: Synthetic humanized antibody 76E1-huVH3 VH FR3
RATISRDKAKNSLYMQLNSLRAEDTAVYYCAR

SEQ ID NO: 500 - protein, 32 aa, Artificial Sequence
  Description of Artificial Sequence: Synthetic humanized antibody 76E1-huVH3 VH FR3
RATISRDKAKNSLYMQMNSLRAEDTAVYYCAT

SEQ ID NO: 501 - protein, 32 aa, Artificial Sequence
  Description of Artificial Sequence: Synthetic humanized antibody 76E1-huVH3 VH FR3
RATISRDKAKNSLYLQLNSLRAEDTAVYYCAT

SEQ ID NO: 502 - protein, 32 aa, Artificial Sequence
  Description of Artificial Sequence: Synthetic humanized antibody 76E1-huVH3 VH FR3
RATISRDNAKSSAYMQMNSLRAEDTAVYYCAR

SEQ ID NO: 503 - protein, 32 aa, Artificial Sequence
  Description of Artificial Sequence: Synthetic humanized antibody 76E1-huVH3 VH FR3
RATISRDNAKSSAYLQLNSLRAEDTAVYYCAR

SEQ ID NO: 504 - protein, 32 aa, Artificial Sequence
  Description of Artificial Sequence: Synthetic humanized antibody 76E1-huVH3 VH FR3
RATISRDNAKSSAYLQMNSLRAEDTAVYYCAT

SEQ ID NO: 505 - protein, 32 aa, Artificial Sequence
  Description of Artificial Sequence: Synthetic humanized antibody 76E1-huVH3 VH FR3
RATISRDNAKSSLYMQLNSLRAEDTAVYYCAR

SEQ ID NO: 506 - protein, 32 aa, Artificial Sequence
  Description of Artificial Sequence: Synthetic humanized antibody 76E1-huVH3 VH FR3
RATISRDNAKSSLYMQMNSLRAEDTAVYYCAT

SEQ ID NO: 507 - protein, 32 aa, Artificial Sequence
  Description of Artificial Sequence: Synthetic humanized antibody 76E1-huVH3 VH FR3
RATISRDNAKSSLYLQLNSLRAEDTAVYYCAT

SEQ ID NO: 508 - protein, 32 aa, Artificial Sequence; identical to SEQ ID NO: 207
  Description of Artificial Sequence: Synthetic humanized antibody 76E1-huVH3 VH FR3

SEQ ID NO: 509 - protein, 32 aa, Artificial Sequence
  Description of Artificial Sequence: Synthetic humanized antibody 76E1-huVH3 VH FR3
RATISRDNAKNSAYMQMNSLRAEDTAVYYCAT

SEQ ID NO: 510 - protein, 32 aa, Artificial Sequence
  Description of Artificial Sequence: Synthetic humanized antibody 76E1-huVH3 VH FR3
RATISRDNAKNSAYLQLNSLRAEDTAVYYCAT

SEQ ID NO: 511 - protein, 32 aa, Artificial Sequence
  Description of Artificial Sequence: Synthetic humanized antibody 76E1-huVH3 VH FR3
RATISRDNAKNSLYMQLNSLRAEDTAVYYCAT

SEQ ID NO: 512 - protein, 32 aa, Artificial Sequence
  Description of Artificial Sequence: Synthetic humanized antibody 76E1-huVH3 VH FR3
RFTLSVDKAKSSLYLQMNSLRAEDTAVYYCAR

SEQ ID NO: 513 - protein, 32 aa, Artificial Sequence
  Description of Artificial Sequence: Synthetic humanized antibody 76E1-huVH3 VH FR3
RFTLSVDKAKNSAYLQMNSLRAEDTAVYYCAR

SEQ ID NO: 514 - protein, 32 aa, Artificial Sequence
  Description of Artificial Sequence: Synthetic humanized antibody 76E1-huVH3 VH FR3
RFTLSVDKAKNSLYMQMNSLRAEDTAVYYCAR

SEQ ID NO: 515 - protein, 32 aa, Artificial Sequence
  Description of Artificial Sequence: Synthetic humanized antibody 76E1-huVH3 VH FR3
RFTLSVDKAKNSLYLQLNSLRAEDTAVYYCAR

SEQ ID NO: 516 - protein, 32 aa, Artificial Sequence
  Description of Artificial Sequence: Synthetic humanized antibody 76E1-huVH3 VH FR3
RFTLSVDKAKNSLYLQMNSLRAEDTAVYYCAT

SEQ ID NO: 517 - protein, 32 aa, Artificial Sequence
  Description of Artificial Sequence: Synthetic humanized antibody 76E1-huVH3 VH FR3
RFTLSVDNAKSSAYLQMNSLRAEDTAVYYCAR

SEQ ID NO: 518 - protein, 32 aa, Artificial Sequence
  Description of Artificial Sequence: Synthetic humanized antibody 76E1-huVH3 VH FR3
RFTLSVDNAKSSLYMQMNSLRAEDTAVYYCAR

SEQ ID NO: 519 - protein, 32 aa, Artificial Sequence
  Description of Artificial Sequence: Synthetic humanized antibody 76E1-huVH3 VH FR3
RFTLSVDNAKSSLYLQLNSLRAEDTAVYYCAR

SEQ ID NO: 520 - protein, 32 aa, Artificial Sequence
  Description of Artificial Sequence: Synthetic humanized antibody 76E1-huVH3 VH FR3
RFTLSVDNAKSSLYLQMNSLRAEDTAVYYCAT

SEQ ID NO: 521 - protein, 32 aa, Artificial Sequence
  Description of Artificial Sequence: Synthetic humanized antibody 76E1-huVH3 VH FR3
RFTLSVDNAKNSAYMQMNSLRAEDTAVYYCAR

SEQ ID NO: 522 - protein, 32 aa, Artificial Sequence
  Description of Artificial Sequence: Synthetic humanized antibody 76E1-huVH3 VH FR3
RFTLSVDNAKNSAYLQLNSLRAEDTAVYYCAR

SEQ ID NO: 523 - protein, 32 aa, Artificial Sequence
  Description of Artificial Sequence: Synthetic humanized antibody 76E1-huVH3 VH FR3
RFTLSVDNAKNSAYLQMNSLRAEDTAVYYCAT

SEQ ID NO: 524 - protein, 32 aa, Artificial Sequence
  Description of Artificial Sequence: Synthetic humanized antibody 76E1-huVH3 VH FR3
RFTLSVDNAKNSLYMQLNSLRAEDTAVYYCAR

SEQ ID NO: 525 - protein, 32 aa, Artificial Sequence
  Description of Artificial Sequence: Synthetic humanized antibody 76E1-huVH3 VH FR3
RFTLSVDNAKNSLYMQMNSLRAEDTAVYYCAT

SEQ ID NO: 526 - protein, 32 aa, Artificial Sequence
  Description of Artificial Sequence: Synthetic humanized antibody 76E1-huVH3 VH FR3
RFTLSVDNAKNSLYLQLNSLRAEDTAVYYCAT

SEQ ID NO: 527 - protein, 32 aa, Artificial Sequence
  Description of Artificial Sequence: Synthetic humanized antibody 76E1-huVH3 VH FR3
RFTLSRDKASNSAYLQMNSLRAEDTAVYYCAR

SEQ ID NO: 528 - protein, 32 aa, Artificial Sequence
  Description of Artificial Sequence: Synthetic humanized antibody 76E1-huVH3 VH FR3
RFTLSRDKASNSLYMQMNSLRAEDTAVYYCAR

SEQ ID NO: 529 - protein, 32 aa, Artificial Sequence
  Description of Artificial Sequence: Synthetic humanized antibody 76E1-huVH3 VH FR3
RFTLSRDKASNSLYLQLNSLRAEDTAVYYCAR

SEQ ID NO: 530 - protein, 32 aa, Artificial Sequence
  Description of Artificial Sequence: Synthetic humanized antibody 76E1-huVH3 VH FR3
RFTLSRDKASNSLYLQMNSLRAEDTAVYYCAT

SEQ ID NO: 531 - protein, 32 aa, Artificial Sequence
  Description of Artificial Sequence: Synthetic humanized antibody 76E1-huVH3 VH FR3
RFTLSRDKAKNSAYMQMNSLRAEDTAVYYCAR

SEQ ID NO: 532 - protein, 32 aa, Artificial Sequence
  Description of Artificial Sequence: Synthetic humanized antibody 76E1-huVH3 VH FR3
RFTLSRDKAKNSAYLQLNSLRAEDTAVYYCAR

SEQ ID NO: 533 - protein, 32 aa, Artificial Sequence
  Description of Artificial Sequence: Synthetic humanized antibody 76E1-huVH3 VH FR3
RFTLSRDKAKNSAYLQMNSLRAEDTAVYYCAT

SEQ ID NO: 534 - protein, 32 aa, Artificial Sequence
  Description of Artificial Sequence: Synthetic humanized antibody 76E1-huVH3 VH FR3
RFTLSRDKAKNSLYMQLNSLRAEDTAVYYCAR

SEQ ID NO: 535 - protein, 32 aa, Artificial Sequence
  Description of Artificial Sequence: Synthetic humanized antibody 76E1-huVH3 VH FR3
RFTLSRDKAKNSLYMQMNSLRAEDTAVYYCAT

SEQ ID NO: 536 - protein, 32 aa, Artificial Sequence
  Description of Artificial Sequence: Synthetic humanized antibody 76E1-huVH3 VH FR3
RFTLSRDKAKNSLYLQLNSLRAEDTAVYYCAT

SEQ ID NO: 537 - protein, 32 aa, Artificial Sequence
  Description of Artificial Sequence: Synthetic humanized antibody 76E1-huVH3 VH FR3
RFTLSRDNAKSSAYMQMNSLRAEDTAVYYCAR

SEQ ID NO: 538 - protein, 32 aa, Artificial Sequence
  Description of Artificial Sequence: Synthetic humanized antibody 76E1-huVH3 VH FR3
RFTLSRDNAKSSAYLQLNSLRAEDTAVYYCAR

SEQ ID NO: 539 - protein, 32 aa, Artificial Sequence
  Description of Artificial Sequence: Synthetic humanized antibody 76E1-huVH3 VH FR3
RFTLSRDNAKSSAYLQMNSLRAEDTAVYYCAT

SEQ ID NO: 540 - protein, 32 aa, Artificial Sequence
  Description of Artificial Sequence: Synthetic humanized antibody 76E1-huVH3 VH FR3
RFTLSRDNAKSSLYMQLNSLRAEDTAVYYCAR

SEQ ID NO: 541 - protein, 32 aa, Artificial Sequence
  Description of Artificial Sequence: Synthetic humanized antibody 76E1-huVH3 VH FR3
RFTLSRDNAKSSLYMQMNSLRAEDTAVYYCAT

SEQ ID NO: 542 - protein, 32 aa, Artificial Sequence
  Description of Artificial Sequence: Synthetic humanized antibody 76E1-huVH3 VH FR3
RFTLSRDNAKSSLYLQLNSLRAEDTAVYYCAT

SEQ ID NO: 543 - protein, 32 aa, Artificial Sequence
  Description of Artificial Sequence: Synthetic humanized antibody 76E1-huVH3 VH FR3
RFTLSRDNAKNSAYMQLNSLRAEDTAVYYCAR

SEQ ID NO: 544 - protein, 32 aa, Artificial Sequence
  Description of Artificial Sequence: Synthetic humanized antibody 76E1-huVH3 VH FR3
RFTLSRDNAKNSAYMQMNSLRAEDTAVYYCAT

SEQ ID NO: 545 - protein, 32 aa, Artificial Sequence
  Description of Artificial Sequence: Synthetic humanized antibody 76E1-huVH3 VH FR3
RFTLSRDNAKNSAYLQLNSLRAEDTAVYYCAT

SEQ ID NO: 546 - protein, 32 aa, Artificial Sequence
  Description of Artificial Sequence: Synthetic humanized antibody 76E1-huVH3 VH FR3
RFTLSRDNAKNSLYMQLNSLRAEDTAVYYCAT

SEQ ID NO: 547 - protein, 32 aa, Artificial Sequence
  Description of Artificial Sequence: Synthetic humanized antibody 76E1-huVH3 VH FR3
RFTISVDKAKSSAYLQMNSLRAEDTAVYYCAR

SEQ ID NO: 548 - protein, 32 aa, Artificial Sequence
  Description of Artificial Sequence: Synthetic humanized antibody 76E1-huVH3 VH FR3
RFTISVDKAKSSLYMQMNSLRAEDTAVYYCAR

SEQ ID NO: 549 - protein, 32 aa, Artificial Sequence
  Description of Artificial Sequence: Synthetic humanized antibody 76E1-huVH3 VH FR3
RFTISVDKAKSSLYLQLNSLRAEDTAVYYCAR

SEQ ID NO: 550 - protein, 32 aa, Artificial Sequence
  Description of Artificial Sequence: Synthetic humanized antibody 76E1-huVH3 VH FR3
RFTISVDKAKSSLYLQMNSLRAEDTAVYYCAT

SEQ ID NO: 551 - protein, 32 aa, Artificial Sequence
  Description of Artificial Sequence: Synthetic humanized antibody 76E1-huVH3 VH FR3
RFTISVDKAKNSAYMQMNSLRAEDTAVYYCAR

SEQ ID NO: 552 - protein, 32 aa, Artificial Sequence
  Description of Artificial Sequence: Synthetic humanized antibody 76E1-huVH3 VH FR3
RFTISVDKAKNSAYLQLNSLRAEDTAVYYCAR

SEQ ID NO: 553 - protein, 32 aa, Artificial Sequence
  Description of Artificial Sequence: Synthetic humanized antibody 76E1-huVH3 VH FR3
RFTISVDKAKNSAYLQMNSLRAEDTAVYYCAT

SEQ ID NO: 554 - protein, 32 aa, Artificial Sequence
  Description of Artificial Sequence: Synthetic humanized antibody 76E1-huVH3 VH FR3
RFTISVDKAKNSLYMQLNSLRAEDTAVYYCAR

SEQ ID NO: 555 - protein, 32 aa, Artificial Sequence
  Description of Artificial Sequence: Synthetic humanized antibody 76E1-huVH3 VH FR3
RFTISVDKAKNSLYMQMNSLRAEDTAVYYCAT

SEQ ID NO: 556 - protein, 32 aa, Artificial Sequence
  Description of Artificial Sequence: Synthetic humanized antibody 76E1-huVH3 VH FR3
RFTISVDKAKNSLYLQLNSLRAEDTAVYYCAT

SEQ ID NO: 557 - protein, 32 aa, Artificial Sequence
  Description of Artificial Sequence: Synthetic humanized antibody 76E1-huVH3 VH FR3
RFTISVDNAKSSAYLQLNSLRAEDTAVYYCAR

SEQ ID NO: 558 - protein, 32 aa, Artificial Sequence
  Description of Artificial Sequence: Synthetic humanized antibody 76E1-huVH3 VH FR3
RFTISVDNAKSSAYLQMNSLRAEDTAVYYCAT

SEQ ID NO: 559 - protein, 32 aa, Artificial Sequence
  Description of Artificial Sequence: Synthetic humanized antibody 76E1-huVH3 VH FR3
RFTISVDNAKSSLYMQLNSLRAEDTAVYYCAR

SEQ ID NO: 560 - protein, 32 aa, Artificial Sequence
  Description of Artificial Sequence: Synthetic humanized antibody 76E1-huVH3 VH FR3
RFTISVDNAKSSLYMQMNSLRAEDTAVYYCAT

SEQ ID NO: 561 - protein, 32 aa, Artificial Sequence
  Description of Artificial Sequence: Synthetic humanized antibody 76E1-huVH3 VH FR3
RFTISVDNAKSSLYLQLNSLRAEDTAVYYCAT

SEQ ID NO: 562 - protein, 32 aa, Artificial Sequence
  Description of Artificial Sequence: Synthetic humanized antibody 76E1-huVH3 VH FR3
RFTISVDNAKNSAYMQLNSLRAEDTAVYYCAR

SEQ ID NO: 563 - protein, 32 aa, Artificial Sequence
  Description of Artificial Sequence: Synthetic humanized antibody 76E1-huVH3 VH FR3
RFTISVDNAKNSAYMQMNSLRAEDTAVYYCAT

SEQ ID NO: 564 - protein, 32 aa, Artificial Sequence
  Description of Artificial Sequence: Synthetic humanized antibody 76E1-huVH3 VH FR3
RFTISVDNAKNSAYLQLNSLRAEDTAVYYCAT

SEQ ID NO: 565 - protein, 32 aa, Artificial Sequence
  Description of Artificial Sequence: Synthetic humanized antibody 76E1-huVH3 VH FR3
RFTISVDNAKNSLYMQLNSLRAEDTAVYYCAT

SEQ ID NO: 566 - protein, 32 aa, Artificial Sequence
  Description of Artificial Sequence: Synthetic humanized antibody 76E1-huVH3 VH FR3
RFTISRDKAKSSAYMQMNSLRAEDTAVYYCAR

SEQ ID NO: 567 - protein, 32 aa, Artificial Sequence
  Description of Artificial Sequence: Synthetic humanized antibody 76E1-huVH3 VH FR3
RFTISRDKAKSSAYLQLNSLRAEDTAVYYCAR

SEQ ID NO: 568 - protein, 32 aa, Artificial Sequence
  Description of Artificial Sequence: Synthetic humanized antibody 76E1-huVH3 VH FR3
RFTISRDKAKSSAYLQMNSLRAEDTAVYYCAT

SEQ ID NO: 569 - protein, 32 aa, Artificial Sequence
  Description of Artificial Sequence: Synthetic humanized antibody 76E1-huVH3 VH FR3
RFTISRDKAKSSLYMQLNSLRAEDTAVYYCAR

SEQ ID NO: 570 - protein, 32 aa, Artificial Sequence
  Description of Artificial Sequence: Synthetic humanized antibody 76E1-huVH3 VH FR3
RFTISRDKAKSSLYMQMNSLRAEDTAVYYCAT

SEQ ID NO: 571 - protein, 32 aa, Artificial Sequence
  Description of Artificial Sequence: Synthetic humanized antibody 76E1-huVH3 VH FR3
RFTISRDKAKSSLYLQLNSLRAEDTAVYYCAT

SEQ ID NO: 572 - protein, 32 aa, Artificial Sequence
  Description of Artificial Sequence: Synthetic humanized antibody 76E1-huVH3 VH FR3
RFTISRDKAKNSAYMQLNSLRAEDTAVYYCAR

SEQ ID NO: 573 - protein, 32 aa, Artificial Sequence
  Description of Artificial Sequence: Synthetic humanized antibody 76E1-huVH3 VH FR3
RFTISRDKAKNSAYMQMNSLRAEDTAVYYCAT

SEQ ID NO: 574 - protein, 32 aa, Artificial Sequence
  Description of Artificial Sequence: Synthetic humanized antibody 76E1-huVH3 VH FR3
RFTISRDKAKNSAYLQLNSLRAEDTAVYYCAT

SEQ ID NO: 575 - protein, 32 aa, Artificial Sequence
  Description of Artificial Sequence: Synthetic humanized antibody 76E1-huVH3 VH FR3
RFTISRDKAKNSLYMQLNSLRAEDTAVYYCAT

SEQ ID NO: 576 - protein, 32 aa, Artificial Sequence
  Description of Artificial Sequence: Synthetic humanized antibody 76E1-huVH3 VH FR3
RFTISRDNAKSSAYMQLNSLRAEDTAVYYCAR

SEQ ID NO: 577 - protein, 32 aa, Artificial Sequence
  Description of Artificial Sequence: Synthetic humanized antibody 76E1-huVH3 VH FR3
RFTISRDNAKSSAYMQMNSLRAEDTAVYYCAT

SEQ ID NO: 578 - protein, 32 aa, Artificial Sequence
  Description of Artificial Sequence: Synthetic humanized antibody 76E1-huVH3 VH FR3
RFTISRDNAKSSAYLQLNSLRAEDTAVYYCAT

SEQ ID NO: 579 - protein, 32 aa, Artificial Sequence
  Description of Artificial Sequence: Synthetic humanized antibody 76E1-huVH3 VH FR3
RFTISRDNAKSSLYMQLNSLRAEDTAVYYCAT

SEQ ID NO: 580 - protein, 32 aa, Artificial Sequence
  Description of Artificial Sequence: Synthetic humanized antibody 76E1-huVH3 VH FR3
RFTISRDNAKNSAYMQLNSLRAEDTAVYYCAT

SEQ ID NO: 581 - protein, 32 aa, Artificial Sequence
  Description of Artificial Sequence: Synthetic humanized antibody 76E1-huVH3 VH FR3
RATLSVDKASNSLYLQMNSLRAEDTAVYYCAR

SEQ ID NO: 582 - protein, 32 aa, Artificial Sequence
  Description of Artificial Sequence: Synthetic humanized antibody 76E1-huVH3 VH FR3
RATLSVDKAKNSAYLQMNSLRAEDTAVYYCAR

SEQ ID NO: 583 - protein, 32 aa, Artificial Sequence
  Description of Artificial Sequence: Synthetic humanized antibody 76E1-huVH3 VH FR3
RATLSVDKAKNSLYMQMNSLRAEDTAVYYCAR

SEQ ID NO: 584 - protein, 32 aa, Artificial Sequence
  Description of Artificial Sequence: Synthetic humanized antibody 76E1-huVH3 VH FR3
RATLSVDKAKNSLYLQLNSLRAEDTAVYYCAR

SEQ ID NO: 585 - protein, 32 aa, Artificial Sequence
  Description of Artificial Sequence: Synthetic humanized antibody 76E1-huVH3 VH FR3
RATLSVDKAKNSLYLQMNSLRAEDTAVYYCAT

SEQ ID NO: 586 - protein, 32 aa, Artificial Sequence
  Description of Artificial Sequence: Synthetic humanized antibody 76E1-huVH3 VH FR3
RATLSVDNAKSSAYLQMNSLRAEDTAVYYCAR

SEQ ID NO: 587 - protein, 32 aa, Artificial Sequence
  Description of Artificial Sequence: Synthetic humanized antibody 76E1-huVH3 VH FR3
RATLSVDNAKSSLYMQMNSLRAEDTAVYYCAR

SEQ ID NO: 588 - protein, 32 aa, Artificial Sequence
  Description of Artificial Sequence: Synthetic humanized antibody 76E1-huVH3 VH FR3
RATLSVDNAKSSLYLQLNSLRAEDTAVYYCAR

SEQ ID NO: 589 - protein, 32 aa, Artificial Sequence
  Description of Artificial Sequence: Synthetic humanized antibody 76E1-huVH3 VH FR3
RATLSVDNAKSSLYLQMNSLRAEDTAVYYCAT

SEQ ID NO: 590 - protein, 32 aa, Artificial Sequence
  Description of Artificial Sequence: Synthetic humanized antibody 76E1-huVH3 VH FR3
RATLSVDNAKNSAYMQMNSLRAEDTAVYYCAR

SEQ ID NO: 591 - protein, 32 aa, Artificial Sequence
  Description of Artificial Sequence: Synthetic humanized antibody 76E1-huVH3 VH FR3
RATLSVDNAKNSAYLQLNSLRAEDTAVYYCAR

SEQ ID NO: 592 - protein, 32 aa, Artificial Sequence
  Description of Artificial Sequence: Synthetic humanized antibody 76E1-huVH3 VH FR3
RATLSVDNAKNSAYLQMNSLRAEDTAVYYCAT

SEQ ID NO: 593 - protein, 32 aa, Artificial Sequence
  Description of Artificial Sequence: Synthetic humanized antibody 76E1-huVH3 VH FR3
RATLSVDNAKNSLYMQLNSLRAEDTAVYYCAR

SEQ ID NO: 594 - protein, 32 aa, Artificial Sequence
  Description of Artificial Sequence: Synthetic humanized antibody 76E1-huVH3 VH FR3
RATLSVDNAKNSLYMQMNSLRAEDTAVYYCAT

SEQ ID NO: 595 - protein, 32 aa, Artificial Sequence
  Description of Artificial Sequence: Synthetic humanized antibody 76E1-huVH3 VH FR3
RATLSVDNAKNSLYLQLNSLRAEDTAVYYCAT

SEQ ID NO: 596 - protein, 32 aa, Artificial Sequence
  Description of Artificial Sequence: Synthetic humanized antibody 76E1-huVH3 VH FR3
RATLSRDKAKSSAYLQMNSLRAEDTAVYYCAR

SEQ ID NO: 597 - protein, 32 aa, Artificial Sequence
  Description of Artificial Sequence: Synthetic humanized antibody 76E1-huVH3 VH FR3
RATLSRDKAKSSLYMQMNSLRAEDTAVYYCAR

SEQ ID NO: 598 - protein, 32 aa, Artificial Sequence
  Description of Artificial Sequence: Synthetic humanized antibody 76E1-huVH3 VH FR3
RATLSRDKAKSSLYLQLNSLRAEDTAVYYCAR

SEQ ID NO: 599 - protein, 32 aa, Artificial Sequence
  Description of Artificial Sequence: Synthetic humanized antibody 76E1-huVH3 VH FR3
RATLSRDKAKSSLYLQMNSLRAEDTAVYYCAT

SEQ ID NO: 600 - protein, 32 aa, Artificial Sequence
  Description of Artificial Sequence: Synthetic humanized antibody 76E1-huVH3 VH FR3
RATLSRDKAKNSAYMQMNSLRAEDTAVYYCAR

SEQ ID NO: 601 - protein, 32 aa, Artificial Sequence
  Description of Artificial Sequence: Synthetic humanized antibody 76E1-huVH3 VH FR3
RATLSRDKAKNSAYLQLNSLRAEDTAVYYCAR

SEQ ID NO: 602 - protein, 32 aa, Artificial Sequence
  Description of Artificial Sequence: Synthetic humanized antibody 76E1-huVH3 VH FR3
RATLSRDKAKNSAYLQMNSLRAEDTAVYYCAT

SEQ ID NO: 603 - protein, 32 aa, Artificial Sequence
  Description of Artificial Sequence: Synthetic humanized antibody 76E1-huVH3 VH FR3
RATLSRDKAKNSLYMQLNSLRAEDTAVYYCAR

SEQ ID NO: 604 - protein, 32 aa, Artificial Sequence
  Description of Artificial Sequence: Synthetic humanized antibody 76E1-huVH3 VH FR3
RATLSRDKAKNSLYMQMNSLRAEDTAVYYCAT

SEQ ID NO: 605 - protein, 32 aa, Artificial Sequence
  Description of Artificial Sequence: Synthetic humanized antibody 76E1-huVH3 VH FR3
RATLSRDKAKNSLYLQLNSLRAEDTAVYYCAT

SEQ ID NO: 606 - protein, 32 aa, Artificial Sequence
  Description of Artificial Sequence: Synthetic humanized antibody 76E1-huVH3 VH FR3
RATLSRDNAKSSAYMQMNSLRAEDTAVYYCAR

SEQ ID NO: 607 - protein, 32 aa, Artificial Sequence
  Description of Artificial Sequence: Synthetic humanized antibody 76E1-huVH3 VH FR3
RATLSRDNAKSSAYLQLNSLRAEDTAVYYCAR

SEQ ID NO: 608 - protein, 32 aa, Artificial Sequence
  Description of Artificial Sequence: Synthetic humanized antibody 76E1-huVH3 VH FR3
RATLSRDNAKSSAYLQMNSLRAEDTAVYYCAT

SEQ ID NO: 609 - protein, 32 aa, Artificial Sequence
  Description of Artificial Sequence: Synthetic humanized antibody 76E1-huVH3 VH FR3
RATLSRDNAKSSLYMQLNSLRAEDTAVYYCAR

SEQ ID NO: 610 - protein, 32 aa, Artificial Sequence
  Description of Artificial Sequence: Synthetic humanized antibody 76E1-huVH3 VH FR3
RATLSRDNAKSSLYMQMNSLRAEDTAVYYCAT

SEQ ID NO: 611 - protein, 32 aa, Artificial Sequence
  Description of Artificial Sequence: Synthetic humanized antibody 76E1-huVH3 VH FR3
RATLSRDNAKSSLYLQLNSLRAEDTAVYYCAT

SEQ ID NO: 612 - protein, 32 aa, Artificial Sequence
  Description of Artificial Sequence: Synthetic humanized antibody 76E1-huVH3 VH FR3
RATLSRDNAKNSAYMQLNSLRAEDTAVYYCAR

SEQ ID NO: 613 - protein, 32 aa, Artificial Sequence
  Description of Artificial Sequence: Synthetic humanized antibody 76E1-huVH3 VH FR3
RATLSRDNAKNSAYMQMNSLRAEDTAVYYCAT

SEQ ID NO: 614 - protein, 32 aa, Artificial Sequence
  Description of Artificial Sequence: Synthetic humanized antibody 76E1-huVH3 VH FR3
RATLSRDNAKNSAYLQLNSLRAEDTAVYYCAT

SEQ ID NO: 615 - protein, 32 aa, Artificial Sequence
  Description of Artificial Sequence: Synthetic humanized antibody 76E1-huVH3 VH FR3
RATLSRDNAKNSLYMQLNSLRAEDTAVYYCAT

SEQ ID NO: 616 - protein, 32 aa, Artificial Sequence
  Description of Artificial Sequence: Synthetic humanized antibody 76E1-huVH3 VH FR3
RATISVDKAKSSAYLQMNSLRAEDTAVYYCAR

SEQ ID NO: 617 - protein, 32 aa, Artificial Sequence
  Description of Artificial Sequence: Synthetic humanized antibody 76E1-huVH3 VH FR3
RATISVDKAKSSLYMQMNSLRAEDTAVYYCAR

SEQ ID NO: 618 - protein, 32 aa, Artificial Sequence
  Description of Artificial Sequence: Synthetic humanized antibody 76E1-huVH3 VH FR3
RATISVDKAKSSLYLQLNSLRAEDTAVYYCAR

SEQ ID NO: 619 - protein, 32 aa, Artificial Sequence
  Description of Artificial Sequence: Synthetic humanized antibody 76E1-huVH3 VH FR3
RATISVDKAKSSLYLQMNSLRAEDTAVYYCAT

SEQ ID NO: 620 - protein, 32 aa, Artificial Sequence
  Description of Artificial Sequence: Synthetic humanized antibody 76E1-huVH3 VH FR3
RATISVDKAKNSAYMQMNSLRAEDTAVYYCAR

SEQ ID NO: 621 - protein, 32 aa, Artificial Sequence
  Description of Artificial Sequence: Synthetic humanized antibody 76E1-huVH3 VH FR3
RATISVDKAKNSAYLQLNSLRAEDTAVYYCAR

SEQ ID NO: 622 - protein, 32 aa, Artificial Sequence
  Description of Artificial Sequence: Synthetic humanized antibody 76E1-huVH3 VH FR3
RATISVDKAKNSAYLQMNSLRAEDTAVYYCAT

SEQ ID NO: 623 - protein, 32 aa, Artificial Sequence
  Description of Artificial Sequence: Synthetic humanized antibody 76E1-huVH3 VH FR3
RATISVDKAKNSLYMQLNSLRAEDTAVYYCAR

SEQ ID NO: 624 - protein, 32 aa, Artificial Sequence
  Description of Artificial Sequence: Synthetic humanized antibody 76E1-huVH3 VH FR3
RATISVDKAKNSLYMQMNSLRAEDTAVYYCAT

SEQ ID NO: 625 - protein, 32 aa, Artificial Sequence
  Description of Artificial Sequence: Synthetic humanized antibody 76E1-huVH3 VH FR3
RATISVDKAKNSLYLQLNSLRAEDTAVYYCAT

SEQ ID NO: 626 - protein, 32 aa, Artificial Sequence
  Description of Artificial Sequence: Synthetic humanized antibody 76E1-huVH3 VH FR3
RATISVDNAKSSAYMQMNSLRAEDTAVYYCAR

SEQ ID NO: 627 - protein, 32 aa, Artificial Sequence
  Description of Artificial Sequence: Synthetic humanized antibody 76E1-huVH3 VH FR3
RATISVDNAKSSAYLQLNSLRAEDTAVYYCAR

SEQ ID NO: 628 - protein, 32 aa, Artificial Sequence
  Description of Artificial Sequence: Synthetic humanized antibody 76E1-huVH3 VH FR3
RATISVDNAKSSAYLQMNSLRAEDTAVYYCAT

SEQ ID NO: 629 - protein, 32 aa, Artificial Sequence
  Description of Artificial Sequence: Synthetic humanized antibody 76E1-huVH3 VH FR3
RATISVDNAKSSLYMQLNSLRAEDTAVYYCAR

SEQ ID NO: 630 - protein, 32 aa, Artificial Sequence
  Description of Artificial Sequence: Synthetic humanized antibody 76E1-huVH3 VH FR3
RATISVDNAKSSLYMQMNSLRAEDTAVYYCAT

SEQ ID NO: 631 - protein, 32 aa, Artificial Sequence
  Description of Artificial Sequence: Synthetic humanized antibody 76E1-huVH3 VH FR3
RATISVDNAKSSLYLQLNSLRAEDTAVYYCAT

SEQ ID NO: 632 - protein, 32 aa, Artificial Sequence
  Description of Artificial Sequence: Synthetic humanized antibody 76E1-huVH3 VH FR3
RATISVDNAKNSAYMQLNSLRAEDTAVYYCAR

SEQ ID NO: 633 - protein, 32 aa, Artificial Sequence
  Description of Artificial Sequence: Synthetic humanized antibody 76E1-huVH3 VH FR3
RATISVDNAKNSAYMQMNSLRAEDTAVYYCAT

SEQ ID NO: 634 - protein, 32 aa, Artificial Sequence
  Description of Artificial Sequence: Synthetic humanized antibody 76E1-huVH3 VH FR3
RATISVDNAKNSAYLQLNSLRAEDTAVYYCAT

SEQ ID NO: 635 - protein, 32 aa, Artificial Sequence
  Description of Artificial Sequence: Synthetic humanized antibody 76E1-huVH3 VH FR3
RATISVDNAKNSLYMQLNSLRAEDTAVYYCAT

SEQ ID NO: 636 - protein, 32 aa, Artificial Sequence
  Description of Artificial Sequence: Synthetic humanized antibody 76E1-huVH3 VH FR3
RATISRDKAKSSAYMQMNSLRAEDTAVYYCAR

SEQ ID NO: 637 - protein, 32 aa, Artificial Sequence
  Description of Artificial Sequence: Synthetic humanized antibody 76E1-huVH3 VH FR3
RATISRDKAKSSAYLQLNSLRAEDTAVYYCAR

SEQ ID NO: 638 - protein, 32 aa, Artificial Sequence
  Description of Artificial Sequence: Synthetic humanized antibody 76E1-huVH3 VH FR3
RATISRDKAKSSAYLQMNSLRAEDTAVYYCAT

SEQ ID NO: 639 - protein, 32 aa, Artificial Sequence
  Description of Artificial Sequence: Synthetic humanized antibody 76E1-huVH3 VH FR3
RATISRDKAKSSLYMQLNSLRAEDTAVYYCAR

SEQ ID NO: 640 - protein, 32 aa, Artificial Sequence
  Description of Artificial Sequence: Synthetic humanized antibody 76E1-huVH3 VH FR3
RATISRDKAKSSLYMQMNSLRAEDTAVYYCAT

SEQ ID NO: 641 - protein, 32 aa, Artificial Sequence
  Description of Artificial Sequence: Synthetic humanized antibody 76E1-huVH3 VH FR3
RATISRDKAKSSLYLQLNSLRAEDTAVYYCAT

SEQ ID NO: 642 - protein, 32 aa, Artificial Sequence
  Description of Artificial Sequence: Synthetic humanized antibody 76E1-huVH3 VH FR3
RATISRDKAKNSAYMQLNSLRAEDTAVYYCAR

SEQ ID NO: 643 - protein, 32 aa, Artificial Sequence
  Description of Artificial Sequence: Synthetic humanized antibody 76E1-huVH3 VH FR3
RATISRDKAKNSAYMQMNSLRAEDTAVYYCAT

SEQ ID NO: 644 - protein, 32 aa, Artificial Sequence
  Description of Artificial Sequence: Synthetic humanized antibody 76E1-huVH3 VH FR3
RATISRDKAKNSAYLQLNSLRAEDTAVYYCAT

SEQ ID NO: 645 - protein, 32 aa, Artificial Sequence
  Description of Artificial Sequence: Synthetic humanized antibody 76E1-huVH3 VH FR3
RATISRDKAKNSLYMQLNSLRAEDTAVYYCAT

SEQ ID NO: 646 - protein, 32 aa, Artificial Sequence
  Description of Artificial Sequence: Synthetic humanized antibody 76E1-huVH3 VH FR3
RATISRDNAKSSAYMQLNSLRAEDTAVYYCAR

SEQ ID NO: 647 - protein, 32 aa, Artificial Sequence
  Description of Artificial Sequence: Synthetic humanized antibody 76E1-huVH3 VH FR3
RATISRDNAKSSAYMQMNSLRAEDTAVYYCAT

SEQ ID NO: 648 - protein, 32 aa, Artificial Sequence
  Description of Artificial Sequence: Synthetic humanized antibody 76E1-huVH3 VH FR3
RATISRDNAKSSAYLQLNSLRAEDTAVYYCAT

SEQ ID NO: 649 - protein, 32 aa, Artificial Sequence
  Description of Artificial Sequence: Synthetic humanized antibody 76E1-huVH3 VH FR3
RATISRDNAKSSLYMQLNSLRAEDTAVYYCAT

SEQ ID NO: 650 - protein, 32 aa, Artificial Sequence
  Description of Artificial Sequence: Synthetic humanized antibody 76E1-huVH3 VH FR3
RATISRDNAKNSAYMQLNSLRAEDTAVYYCAT

SEQ ID NO: 651 - protein, 32 aa, Artificial Sequence
  Description of Artificial Sequence: Synthetic humanized antibody 76E1-huVH3 VH FR3
RFTLSVDKAKSSAYLQMNSLRAEDTAVYYCAR

SEQ ID NO: 652 - protein, 32 aa, Artificial Sequence
  Description of Artificial Sequence: Synthetic humanized antibody 76E1-huVH3 VH FR3
RFTLSVDKAKSSLYMQMNSLRAEDTAVYYCAR

SEQ ID NO: 653 - protein, 32 aa, Artificial Sequence
  Description of Artificial Sequence: Synthetic humanized antibody 76E1-huVH3 VH FR3
RFTLSVDKAKSSLYLQLNSLRAEDTAVYYCAR

SEQ ID NO: 654 - protein, 32 aa, Artificial Sequence
  Description of Artificial Sequence: Synthetic humanized antibody 76E1-huVH3 VH FR3
RFTLSVDKAKSSLYLQMNSLRAEDTAVYYCAT

SEQ ID NO: 655 - protein, 32 aa, Artificial Sequence
  Description of Artificial Sequence: Synthetic humanized antibody 76E1-huVH3 VH FR3
RFTLSVDKAKNSAYMQMNSLRAEDTAVYYCAR

SEQ ID NO: 656 - protein, 32 aa, Artificial Sequence
  Description of Artificial Sequence: Synthetic humanized antibody 76E1-huVH3 VH FR3
RFTLSVDKAKNSAYLQLNSLRAEDTAVYYCAR

SEQ ID NO: 657 - protein, 32 aa, Artificial Sequence
  Description of Artificial Sequence: Synthetic humanized antibody 76E1-huVH3 VH FR3
RFTLSVDKAKNSAYLQMNSLRAEDTAVYYCAT

SEQ ID NO: 658 - protein, 32 aa, Artificial Sequence
  Description of Artificial Sequence: Synthetic humanized antibody 76E1-huVH3 VH FR3
RFTLSVDKAKNSLYMQLNSLRAEDTAVYYCAR

SEQ ID NO: 659 - protein, 32 aa, Artificial Sequence
  Description of Artificial Sequence: Synthetic humanized antibody 76E1-huVH3 VH FR3
RFTLSVDKAKNSLYMQMNSLRAEDTAVYYCAT

SEQ ID NO: 660 - protein, 32 aa, Artificial Sequence
  Description of Artificial Sequence: Synthetic humanized antibody 76E1-huVH3 VH FR3
RFTLSVDKAKNSLYLQLNSLRAEDTAVYYCAT

SEQ ID NO: 661 - protein, 32 aa, Artificial Sequence
  Description of Artificial Sequence: Synthetic humanized antibody 76E1-huVH3 VH FR3
RFTLSVDNAKSSAYMQMNSLRAEDTAVYYCAR

SEQ ID NO: 662 - protein, 32 aa, Artificial Sequence
  Description of Artificial Sequence: Synthetic humanized antibody 76E1-huVH3 VH FR3
RFTLSVDNAKSSAYLQLNSLRAEDTAVYYCAR

SEQ ID NO: 663 - protein, 32 aa, Artificial Sequence
  Description of Artificial Sequence: Synthetic humanized antibody 76E1-huVH3 VH FR3
RFTLSVDNAKSSAYLQMNSLRAEDTAVYYCAT

SEQ ID NO: 664 - protein, 32 aa, Artificial Sequence
  Description of Artificial Sequence: Synthetic humanized antibody 76E1-huVH3 VH FR3
RFTLSVDNAKSSLYMQLNSLRAEDTAVYYCAR

SEQ ID NO: 665 - protein, 32 aa, Artificial Sequence
  Description of Artificial Sequence: Synthetic humanized antibody 76E1-huVH3 VH FR3
RFTLSVDNAKSSLYMQMNSLRAEDTAVYYCAT

SEQ ID NO: 666 - protein, 32 aa, Artificial Sequence
  Description of Artificial Sequence: Synthetic humanized antibody 76E1-huVH3 VH FR3
RFTLSVDNAKSSLYLQLNSLRAEDTAVYYCAT

SEQ ID NO: 667 - protein, 32 aa, Artificial Sequence
  Description of Artificial Sequence: Synthetic humanized antibody 76E1-huVH3 VH FR3
RFTLSVDNAKNSAYMQLNSLRAEDTAVYYCAR

SEQ ID NO: 668 - protein, 32 aa, Artificial Sequence
  Description of Artificial Sequence: Synthetic humanized antibody 76E1-huVH3 VH FR3
RFTLSVDNAKNSAYMQMNSLRAEDTAVYYCAT

SEQ ID NO: 669 - protein, 32 aa, Artificial Sequence
  Description of Artificial Sequence: Synthetic humanized antibody 76E1-huVH3 VH FR3
RFTLSVDNAKNSAYLQLNSLRAEDTAVYYCAT

SEQ ID NO: 670 - protein, 32 aa, Artificial Sequence
  Description of Artificial Sequence: Synthetic humanized antibody 76E1-huVH3 VH FR3
RFTLSVDNAKNSLYMQLNSLRAEDTAVYYCAT

SEQ ID NO: 671 - protein, 32 aa, Artificial Sequence
  Description of Artificial Sequence: Synthetic humanized antibody 76E1-huVH3 VH FR3
RFTLSRDKASNSAYMQMNSLRAEDTAVYYCAR

SEQ ID NO: 672 - protein, 32 aa, Artificial Sequence
  Description of Artificial Sequence: Synthetic humanized antibody 76E1-huVH3 VH FR3
RFTLSRDKASNSAYLQLNSLRAEDTAVYYCAR

SEQ ID NO: 673 - protein, 32 aa, Artificial Sequence
  Description of Artificial Sequence: Synthetic humanized antibody 76E1-huVH3 VH FR3
RFTLSRDKASNSAYLQMNSLRAEDTAVYYCAT

SEQ ID NO: 674 - protein, 32 aa, Artificial Sequence
  Description of Artificial Sequence: Synthetic humanized antibody 76E1-huVH3 VH FR3
RFTLSRDKASNSLYMQLNSLRAEDTAVYYCAR

SEQ ID NO: 675 - protein, 32 aa, Artificial Sequence
  Description of Artificial Sequence: Synthetic humanized antibody 76E1-huVH3 VH FR3
RFTLSRDKASNSLYMQMNSLRAEDTAVYYCAT

SEQ ID NO: 676 - protein, 32 aa, Artificial Sequence
  Description of Artificial Sequence: Synthetic humanized antibody 76E1-huVH3 VH FR3
RFTLSRDKASNSLYLQLNSLRAEDTAVYYCAT

SEQ ID NO: 677 - protein, 32 aa, Artificial Sequence
  Description of Artificial Sequence: Synthetic humanized antibody 76E1-huVH3 VH FR3
RFTLSRDKAKNSAYMQLNSLRAEDTAVYYCAR

SEQ ID NO: 678 - protein, 32 aa, Artificial Sequence
  Description of Artificial Sequence: Synthetic humanized antibody 76E1-huVH3 VH FR3
RFTLSRDKAKNSAYMQMNSLRAEDTAVYYCAT

SEQ ID NO: 679 - protein, 32 aa, Artificial Sequence
  Description of Artificial Sequence: Synthetic humanized antibody 76E1-huVH3 VH FR3
RFTLSRDKAKNSAYLQLNSLRAEDTAVYYCAT

SEQ ID NO: 680 - protein, 32 aa, Artificial Sequence
  Description of Artificial Sequence: Synthetic humanized antibody 76E1-huVH3 VH FR3
RFTLSRDKAKNSLYMQLNSLRAEDTAVYYCAT

SEQ ID NO: 681 - protein, 32 aa, Artificial Sequence
  Description of Artificial Sequence: Synthetic humanized antibody 76E1-huVH3 VH FR3
RFTLSRDNAKSSAYMQLNSLRAEDTAVYYCAR

SEQ ID NO: 682 - protein, 32 aa, Artificial Sequence
  Description of Artificial Sequence: Synthetic humanized antibody 76E1-huVH3 VH FR3
RFTLSRDNAKSSAYMQMNSLRAEDTAVYYCAT

SEQ ID NO: 683 - protein, 32 aa, Artificial Sequence
  Description of Artificial Sequence: Synthetic humanized antibody 76E1-huVH3 VH FR3
RFTLSRDNAKSSAYLQLNSLRAEDTAVYYCAT

SEQ ID NO: 684 - protein, 32 aa, Artificial Sequence
  Description of Artificial Sequence: Synthetic humanized antibody 76E1-huVH3 VH FR3
RFTLSRDNAKSSLYMQLNSLRAEDTAVYYCAT

SEQ ID NO: 685 - protein, 32 aa, Artificial Sequence
  Description of Artificial Sequence: Synthetic humanized antibody 76E1-huVH3 VH FR3
RFTLSRDNAKNSAYMQLNSLRAEDTAVYYCAT

SEQ ID NO: 686 - protein, 32 aa, Artificial Sequence
  Description of Artificial Sequence: Synthetic humanized antibody 76E1-huVH3 VH FR3
RFTISVDKAKSSAYMQMNSLRAEDTAVYYCAR

SEQ ID NO: 687 - protein, 32 aa, Artificial Sequence
  Description of Artificial Sequence: Synthetic humanized antibody 76E1-huVH3 VH FR3
RFTISVDKAKSSAYLQLNSLRAEDTAVYYCAR

SEQ ID NO: 688 - protein, 32 aa, Artificial Sequence
  Description of Artificial Sequence: Synthetic humanized antibody 76E1-huVH3 VH FR3
RFTISVDKAKSSAYLQMNSLRAEDTAVYYCAT

SEQ ID NO: 689 - protein, 32 aa, Artificial Sequence
  Description of Artificial Sequence: Synthetic humanized antibody 76E1-huVH3 VH FR3
RFTISVDKAKSSLYMQLNSLRAEDTAVYYCAR

SEQ ID NO: 690 - protein, 32 aa, Artificial Sequence
  Description of Artificial Sequence: Synthetic humanized antibody 76E1-huVH3 VH FR3
RFTISVDKAKSSLYMQMNSLRAEDTAVYYCAT

SEQ ID NO: 691 - protein, 32 aa, Artificial Sequence
  Description of Artificial Sequence: Synthetic humanized antibody 76E1-huVH3 VH FR3
RFTISVDKAKSSLYLQLNSLRAEDTAVYYCAT

SEQ ID NO: 692 - protein, 32 aa, Artificial Sequence
  Description of Artificial Sequence: Synthetic humanized antibody 76E1-huVH3 VH FR3
RFTISVDKAKNSAYMQLNSLRAEDTAVYYCAR

SEQ ID NO: 693 - protein, 32 aa, Artificial Sequence
  Description of Artificial Sequence: Synthetic humanized antibody 76E1-huVH3 VH FR3
RFTISVDKAKNSAYMQMNSLRAEDTAVYYCAT

SEQ ID NO: 694 - protein, 32 aa, Artificial Sequence
  Description of Artificial Sequence: Synthetic humanized antibody 76E1-huVH3 VH FR3
RFTISVDKAKNSAYLQLNSLRAEDTAVYYCAT

SEQ ID NO: 695 - protein, 32 aa, Artificial Sequence
  Description of Artificial Sequence: Synthetic humanized antibody 76E1-huVH3 VH FR3
RFTISVDKAKNSLYMQLNSLRAEDTAVYYCAT

SEQ ID NO: 696 - protein, 32 aa, Artificial Sequence
  Description of Artificial Sequence: Synthetic humanized antibody 76E1-huVH3 VH FR3
RFTISVDNAKSSAYLQLNSLRAEDTAVYYCAT

SEQ ID NO: 697 - protein, 32 aa, Artificial Sequence
  Description of Artificial Sequence: Synthetic humanized antibody 76E1-huVH3 VH FR3
RFTISVDNAKSSLYMQLNSLRAEDTAVYYCAT

SEQ ID NO: 698 - protein, 32 aa, Artificial Sequence
  Description of Artificial Sequence: Synthetic humanized antibody 76E1-huVH3 VH FR3
RFTISVDNAKNSAYMQLNSLRAEDTAVYYCAT

SEQ ID NO: 699 - protein, 32 aa, Artificial Sequence
  Description of Artificial Sequence: Synthetic humanized antibody 76E1-huVH3 VH FR3
RFTISRDKAKSSAYMQLNSLRAEDTAVYYCAR

SEQ ID NO: 700 - protein, 32 aa, Artificial Sequence
  Description of Artificial Sequence: Synthetic humanized antibody 76E1-huVH3 VH FR3
RFTISRDKAKSSAYMQMNSLRAEDTAVYYCAT

SEQ ID NO: 701 - protein, 32 aa, Artificial Sequence
  Description of Artificial Sequence: Synthetic humanized antibody 76E1-huVH3 VH FR3
RFTISRDKAKSSAYLQLNSLRAEDTAVYYCAT

SEQ ID NO: 702 - protein, 32 aa, Artificial Sequence
  Description of Artificial Sequence: Synthetic humanized antibody 76E1-huVH3 VH FR3
RFTISRDKAKSSLYMQLNSLRAEDTAVYYCAT

SEQ ID NO: 703 - protein, 32 aa, Artificial Sequence
  Description of Artificial Sequence: Synthetic humanized antibody 76E1-huVH3 VH FR3
RFTISRDKAKNSAYMQLNSLRAEDTAVYYCAT

SEQ ID NO: 704 - protein, 32 aa, Artificial Sequence
  Description of Artificial Sequence: Synthetic humanized antibody 76E1-huVH3 VH FR3
RFTISRDNAKSSAYMQLNSLRAEDTAVYYCAT

SEQ ID NO: 705 - protein, 32 aa, Artificial Sequence
  Description of Artificial Sequence: Synthetic humanized antibody 76E1-huVH3 VH FR3
RATLSVDKASNSAYLQMNSLRAEDTAVYYCAR

SEQ ID NO: 706 - protein, 32 aa, Artificial Sequence
  Description of Artificial Sequence: Synthetic humanized antibody 76E1-huVH3 VH FR3
RATLSVDKASNSLYMQMNSLRAEDTAVYYCAR

SEQ ID NO: 707 - protein, 32 aa, Artificial Sequence
  Description of Artificial Sequence: Synthetic humanized antibody 76E1-huVH3 VH FR3
RATLSVDKASNSLYLQLNSLRAEDTAVYYCAR

SEQ ID NO: 708 - protein, 32 aa, Artificial Sequence
  Description of Artificial Sequence: Synthetic humanized antibody 76E1-huVH3 VH FR3
RATLSVDKASNSLYLQMNSLRAEDTAVYYCAT

SEQ ID NO: 709 - protein, 32 aa, Artificial Sequence
  Description of Artificial Sequence: Synthetic humanized antibody 76E1-huVH3 VH FR3
RATLSVDKAKNSAYMQMNSLRAEDTAVYYCAR

SEQ ID NO: 710 - protein, 32 aa, Artificial Sequence
  Description of Artificial Sequence: Synthetic humanized antibody 76E1-huVH3 VH FR3
RATLSVDKAKNSAYLQLNSLRAEDTAVYYCAR

SEQ ID NO: 711 - protein, 32 aa, Artificial Sequence
  Description of Artificial Sequence: Synthetic humanized antibody 76E1-huVH3 VH FR3
RATLSVDKAKNSAYLQMNSLRAEDTAVYYCAT

SEQ ID NO: 712 - protein, 32 aa, Artificial Sequence
  Description of Artificial Sequence: Synthetic humanized antibody 76E1-huVH3 VH FR3
RATLSVDKAKNSLYMQLNSLRAEDTAVYYCAR

SEQ ID NO: 713 - protein, 32 aa, Artificial Sequence
  Description of Artificial Sequence: Synthetic humanized antibody 76E1-huVH3 VH FR3
RATLSVDKAKNSLYMQMNSLRAEDTAVYYCAT

SEQ ID NO: 714 - protein, 32 aa, Artificial Sequence
  Description of Artificial Sequence: Synthetic humanized antibody 76E1-huVH3 VH FR3
RATLSVDKAKNSLYLQLNSLRAEDTAVYYCAT

SEQ ID NO: 715 - protein, 32 aa, Artificial Sequence
  Description of Artificial Sequence: Synthetic humanized antibody 76E1-huVH3 VH FR3
RATLSVDNAKSSAYMQMNSLRAEDTAVYYCAR

SEQ ID NO: 716 - protein, 32 aa, Artificial Sequence
  Description of Artificial Sequence: Synthetic humanized antibody 76E1-huVH3 VH FR3
RATLSVDNAKSSAYLQLNSLRAEDTAVYYCAR

SEQ ID NO: 717 - protein, 32 aa, Artificial Sequence
  Description of Artificial Sequence: Synthetic humanized antibody 76E1-huVH3 VH FR3
RATLSVDNAKSSAYLQMNSLRAEDTAVYYCAT

SEQ ID NO: 718 - protein, 32 aa, Artificial Sequence
  Description of Artificial Sequence: Synthetic humanized antibody 76E1-huVH3 VH FR3
RATLSVDNAKSSLYMQLNSLRAEDTAVYYCAR

SEQ ID NO: 719 - protein, 32 aa, Artificial Sequence
  Description of Artificial Sequence: Synthetic humanized antibody 76E1-huVH3 VH FR3
RATLSVDNAKSSLYMQMNSLRAEDTAVYYCAT

SEQ ID NO: 720 - protein, 32 aa, Artificial Sequence
  Description of Artificial Sequence: Synthetic humanized antibody 76E1-huVH3 VH FR3
RATLSVDNAKSSLYLQLNSLRAEDTAVYYCAT

SEQ ID NO: 721 - protein, 32 aa, Artificial Sequence
  Description of Artificial Sequence: Synthetic humanized antibody 76E1-huVH3 VH FR3
RATLSVDNAKNSAYMQLNSLRAEDTAVYYCAR

SEQ ID NO: 722 - protein, 32 aa, Artificial Sequence
  Description of Artificial Sequence: Synthetic humanized antibody 76E1-huVH3 VH FR3
RATLSVDNAKNSAYMQMNSLRAEDTAVYYCAT

SEQ ID NO: 723 - protein, 32 aa, Artificial Sequence
  Description of Artificial Sequence: Synthetic humanized antibody 76E1-huVH3 VH FR3
RATLSVDNAKNSAYLQLNSLRAEDTAVYYCAT

SEQ ID NO: 724 - protein, 32 aa, Artificial Sequence
  Description of Artificial Sequence: Synthetic humanized antibody 76E1-huVH3 VH FR3
RATLSVDNAKNSLYMQLNSLRAEDTAVYYCAT

SEQ ID NO: 725 - protein, 32 aa, Artificial Sequence
  Description of Artificial Sequence: Synthetic humanized antibody 76E1-huVH3 VH FR3
RATLSRDKAKSSAYMQMNSLRAEDTAVYYCAR

SEQ ID NO: 726 - protein, 32 aa, Artificial Sequence
  Description of Artificial Sequence: Synthetic humanized antibody 76E1-huVH3 VH FR3
RATLSRDKAKSSAYLQLNSLRAEDTAVYYCAR

SEQ ID NO: 727 - protein, 32 aa, Artificial Sequence
  Description of Artificial Sequence: Synthetic humanized antibody 76E1-huVH3 VH FR3
RATLSRDKAKSSAYLQMNSLRAEDTAVYYCAT

SEQ ID NO: 728 - protein, 32 aa, Artificial Sequence
  Description of Artificial Sequence: Synthetic humanized antibody 76E1-huVH3 VH FR3
RATLSRDKAKSSLYMQLNSLRAEDTAVYYCAR

SEQ ID NO: 729 - protein, 32 aa, Artificial Sequence
  Description of Artificial Sequence: Synthetic humanized antibody 76E1-huVH3 VH FR3
RATLSRDKAKSSLYMQMNSLRAEDTAVYYCAT

SEQ ID NO: 730 - protein, 32 aa, Artificial Sequence
  Description of Artificial Sequence: Synthetic humanized antibody 76E1-huVH3 VH FR3
RATLSRDKAKSSLYLQLNSLRAEDTAVYYCAT

SEQ ID NO: 731 - protein, 32 aa, Artificial Sequence
  Description of Artificial Sequence: Synthetic humanized antibody 76E1-huVH3 VH FR3
RATLSRDKAKNSAYMQLNSLRAEDTAVYYCAR

SEQ ID NO: 732 - protein, 32 aa, Artificial Sequence
  Description of Artificial Sequence: Synthetic humanized antibody 76E1-huVH3 VH FR3
RATLSRDKAKNSAYMQMNSLRAEDTAVYYCAT

SEQ ID NO: 733 - protein, 32 aa, Artificial Sequence
  Description of Artificial Sequence: Synthetic humanized antibody 76E1-huVH3 VH FR3
RATLSRDKAKNSAYLQLNSLRAEDTAVYYCAT

SEQ ID NO: 734 - protein, 32 aa, Artificial Sequence
  Description of Artificial Sequence: Synthetic humanized antibody 76E1-huVH3 VH FR3
RATLSRDKAKNSLYMQLNSLRAEDTAVYYCAT

SEQ ID NO: 735 - protein, 32 aa, Artificial Sequence
  Description of Artificial Sequence: Synthetic humanized antibody 76E1-huVH3 VH FR3
RATLSRDNAKSSAYMQLNSLRAEDTAVYYCAR

SEQ ID NO: 736 - protein, 32 aa, Artificial Sequence
  Description of Artificial Sequence: Synthetic humanized antibody 76E1-huVH3 VH FR3
RATLSRDNAKSSAYMQMNSLRAEDTAVYYCAT

SEQ ID NO: 737 - protein, 32 aa, Artificial Sequence
  Description of Artificial Sequence: Synthetic humanized antibody 76E1-huVH3 VH FR3
RATLSRDNAKSSAYLQLNSLRAEDTAVYYCAT

SEQ ID NO: 738 - protein, 32 aa, Artificial Sequence
  Description of Artificial Sequence: Synthetic humanized antibody 76E1-huVH3 VH FR3
RATLSRDNAKSSLYMQLNSLRAEDTAVYYCAT

SEQ ID NO: 739 - protein, 32 aa, Artificial Sequence
  Description of Artificial Sequence: Synthetic humanized antibody 76E1-huVH3 VH FR3
RATLSRDNAKNSAYMQLNSLRAEDTAVYYCAT

SEQ ID NO: 740 - protein, 32 aa, Artificial Sequence
  Description of Artificial Sequence: Synthetic humanized antibody 76E1-huVH3 VH FR3
RATISVDKAKSSAYMQMNSLRAEDTAVYYCAR

SEQ ID NO: 741 - protein, 32 aa, Artificial Sequence
  Description of Artificial Sequence: Synthetic humanized antibody 76E1-huVH3 VH FR3
RATISVDKAKSSAYLQLNSLRAEDTAVYYCAR

SEQ ID NO: 742 - protein, 32 aa, Artificial Sequence
  Description of Artificial Sequence: Synthetic humanized antibody 76E1-huVH3 VH FR3
RATISVDKAKSSAYLQMNSLRAEDTAVYYCAT

SEQ ID NO: 743 - protein, 32 aa, Artificial Sequence
  Description of Artificial Sequence: Synthetic humanized antibody 76E1-huVH3 VH FR3
RATISVDKAKSSLYMQLNSLRAEDTAVYYCAR

SEQ ID NO: 744 - protein, 32 aa, Artificial Sequence
  Description of Artificial Sequence: Synthetic humanized antibody 76E1-huVH3 VH FR3
RATISVDKAKSSLYMQMNSLRAEDTAVYYCAT

SEQ ID NO: 745 - protein, 32 aa, Artificial Sequence
  Description of Artificial Sequence: Synthetic humanized antibody 76E1-huVH3 VH FR3
RATISVDKAKSSLYLQLNSLRAEDTAVYYCAT

SEQ ID NO: 746 - protein, 32 aa, Artificial Sequence
  Description of Artificial Sequence: Synthetic humanized antibody 76E1-huVH3 VH FR3
RATISVDKAKNSAYMQLNSLRAEDTAVYYCAR

SEQ ID NO: 747 - protein, 32 aa, Artificial Sequence
  Description of Artificial Sequence: Synthetic humanized antibody 76E1-huVH3 VH FR3
RATISVDKAKNSAYMQMNSLRAEDTAVYYCAT

SEQ ID NO: 748 - protein, 32 aa, Artificial Sequence
  Description of Artificial Sequence: Synthetic humanized antibody 76E1-huVH3 VH FR3
RATISVDKAKNSAYLQLNSLRAEDTAVYYCAT

SEQ ID NO: 749 - protein, 32 aa, Artificial Sequence
  Description of Artificial Sequence: Synthetic humanized antibody 76E1-huVH3 VH FR3
RATISVDKAKNSLYMQLNSLRAEDTAVYYCAT

SEQ ID NO: 750 - protein, 32 aa, Artificial Sequence
  Description of Artificial Sequence: Synthetic humanized antibody 76E1-huVH3 VH FR3
RATISVDNAKSSAYMQLNSLRAEDTAVYYCAR

SEQ ID NO: 751 - protein, 32 aa, Artificial Sequence
  Description of Artificial Sequence: Synthetic humanized antibody 76E1-huVH3 VH FR3
RATISVDNAKSSAYMQMNSLRAEDTAVYYCAT

SEQ ID NO: 752 - protein, 32 aa, Artificial Sequence
  Description of Artificial Sequence: Synthetic humanized antibody 76E1-huVH3 VH FR3
RATISVDNAKSSAYLQLNSLRAEDTAVYYCAT

SEQ ID NO: 753 - protein, 32 aa, Artificial Sequence
  Description of Artificial Sequence: Synthetic humanized antibody 76E1-huVH3 VH FR3
RATISVDNAKSSLYMQLNSLRAEDTAVYYCAT

SEQ ID NO: 754 - protein, 32 aa, Artificial Sequence
  Description of Artificial Sequence: Synthetic humanized antibody 76E1-huVH3 VH FR3
RATISVDNAKNSAYMQLNSLRAEDTAVYYCAT

SEQ ID NO: 755 - protein, 32 aa, Artificial Sequence
  Description of Artificial Sequence: Synthetic humanized antibody 76E1-huVH3 VH FR3
RATISRDKAKSSAYMQLNSLRAEDTAVYYCAR

SEQ ID NO: 756 - protein, 32 aa, Artificial Sequence
  Description of Artificial Sequence: Synthetic humanized antibody 76E1-huVH3 VH FR3
RATISRDKAKSSAYMQMNSLRAEDTAVYYCAT

SEQ ID NO: 757 - protein, 32 aa, Artificial Sequence
  Description of Artificial Sequence: Synthetic humanized antibody 76E1-huVH3 VH FR3
RATISRDKAKSSAYLQLNSLRAEDTAVYYCAT

SEQ ID NO: 758 - protein, 32 aa, Artificial Sequence
  Description of Artificial Sequence: Synthetic humanized antibody 76E1-huVH3 VH FR3
RATISRDKAKSSLYMQLNSLRAEDTAVYYCAT

SEQ ID NO: 759 - protein, 32 aa, Artificial Sequence
  Description of Artificial Sequence: Synthetic humanized antibody 76E1-huVH3 VH FR3
RATISRDKAKNSAYMQLNSLRAEDTAVYYCAT

SEQ ID NO: 760 - protein, 32 aa, Artificial Sequence
  Description of Artificial Sequence: Synthetic humanized antibody 76E1-huVH3 VH FR3
RATISRDNAKSSAYMQLNSLRAEDTAVYYCAT

SEQ ID NO: 761 - protein, 32 aa, Artificial Sequence
  Description of Artificial Sequence: Synthetic humanized antibody 76E1-huVH3 VH FR3
RFTLSVDKAKSSAYMQMNSLRAEDTAVYYCAR

SEQ ID NO: 762 - protein, 32 aa, Artificial Sequence
  Description of Artificial Sequence: Synthetic humanized antibody 76E1-huVH3 VH FR3
RFTLSVDKAKSSAYLQLNSLRAEDTAVYYCAR

SEQ ID NO: 763 - protein, 32 aa, Artificial Sequence
  Description of Artificial Sequence: Synthetic humanized antibody 76E1-huVH3 VH FR3
RFTLSVDKAKSSAYLQMNSLRAEDTAVYYCAT

SEQ ID NO: 764 - protein, 32 aa, Artificial Sequence
  Description of Artificial Sequence: Synthetic humanized antibody 76E1-huVH3 VH FR3
RFTLSVDKAKSSLYMQLNSLRAEDTAVYYCAR

SEQ ID NO: 765 - protein, 32 aa, Artificial Sequence
  Description of Artificial Sequence: Synthetic humanized antibody 76E1-huVH3 VH FR3
RFTLSVDKAKSSLYMQMNSLRAEDTAVYYCAT

SEQ ID NO: 766 - protein, 32 aa, Artificial Sequence
  Description of Artificial Sequence: Synthetic humanized antibody 76E1-huVH3 VH FR3
RFTLSVDKAKSSLYLQLNSLRAEDTAVYYCAT

SEQ ID NO: 767 - protein, 32 aa, Artificial Sequence
  Description of Artificial Sequence: Synthetic humanized antibody 76E1-huVH3 VH FR3
RFTLSVDKAKNSAYMQLNSLRAEDTAVYYCAR

SEQ ID NO: 768 - protein, 32 aa, Artificial Sequence
  Description of Artificial Sequence: Synthetic humanized antibody 76E1-huVH3 VH FR3
RFTLSVDKAKNSAYMQMNSLRAEDTAVYYCAT

SEQ ID NO: 769 - protein, 32 aa, Artificial Sequence
  Description of Artificial Sequence: Synthetic humanized antibody 76E1-huVH3 VH FR3
RFTLSVDKAKNSAYLQLNSLRAEDTAVYYCAT

SEQ ID NO: 770 - protein, 32 aa, Artificial Sequence
  Description of Artificial Sequence: Synthetic humanized antibody 76E1-huVH3 VH FR3
RFTLSVDKAKNSLYMQLNSLRAEDTAVYYCAT

SEQ ID NO: 771 - protein, 32 aa, Artificial Sequence
  Description of Artificial Sequence: Synthetic humanized antibody 76E1-huVH3 VH FR3
RFTLSVDNAKSSAYMQLNSLRAEDTAVYYCAR

SEQ ID NO: 772 - protein, 32 aa, Artificial Sequence
  Description of Artificial Sequence: Synthetic humanized antibody 76E1-huVH3 VH FR3
RFTLSVDNAKSSAYMQMNSLRAEDTAVYYCAT

SEQ ID NO: 773 - protein, 32 aa, Artificial Sequence
  Description of Artificial Sequence: Synthetic humanized antibody 76E1-huVH3 VH FR3
RFTLSVDNAKSSAYLQLNSLRAEDTAVYYCAT

SEQ ID NO: 774 - protein, 32 aa, Artificial Sequence
  Description of Artificial Sequence: Synthetic humanized antibody 76E1-huVH3 VH FR3
RFTLSVDNAKSSLYMQLNSLRAEDTAVYYCAT

SEQ ID NO: 775 - protein, 32 aa, Artificial Sequence
  Description of Artificial Sequence: Synthetic humanized antibody 76E1-huVH3 VH FR3
RFTLSVDNAKNSAYMQLNSLRAEDTAVYYCAT

SEQ ID NO: 776 - protein, 32 aa, Artificial Sequence
  Description of Artificial Sequence: Synthetic humanized antibody 76E1-huVH3 VH FR3
RFTLSRDKASNSAYMQLNSLRAEDTAVYYCAR

SEQ ID NO: 777 - protein, 32 aa, Artificial Sequence
  Description of Artificial Sequence: Synthetic humanized antibody 76E1-huVH3 VH FR3
RFTLSRDKASNSAYMQMNSLRAEDTAVYYCAT

SEQ ID NO: 778 - protein, 32 aa, Artificial Sequence
  Description of Artificial Sequence: Synthetic humanized antibody 76E1-huVH3 VH FR3
RFTLSRDKASNSAYLQLNSLRAEDTAVYYCAT

SEQ ID NO: 779 - protein, 32 aa, Artificial Sequence
  Description of Artificial Sequence: Synthetic humanized antibody 76E1-huVH3 VH FR3
RFTLSRDKASNSLYMQLNSLRAEDTAVYYCAT

SEQ ID NO: 780 - protein, 32 aa, Artificial Sequence
  Description of Artificial Sequence: Synthetic humanized antibody 76E1-huVH3 VH FR3
RFTLSRDKAKNSAYMQLNSLRAEDTAVYYCAT

SEQ ID NO: 781 - protein, 32 aa, Artificial Sequence
  Description of Artificial Sequence: Synthetic humanized antibody 76E1-huVH3 VH FR3
RFTLSRDNAKSSAYMQLNSLRAEDTAVYYCAT

SEQ ID NO: 782 - protein, 32 aa, Artificial Sequence
  Description of Artificial Sequence: Synthetic humanized antibody 76E1-huVH3 VH FR3
RFTISVDKAKSSAYMQLNSLRAEDTAVYYCAR

SEQ ID NO: 783 - protein, 32 aa, Artificial Sequence
  Description of Artificial Sequence: Synthetic humanized antibody 76E1-huVH3 VH FR3
RFTISVDKAKSSAYMQMNSLRAEDTAVYYCAT

SEQ ID NO: 784 - protein, 32 aa, Artificial Sequence
  Description of Artificial Sequence: Synthetic humanized antibody 76E1-huVH3 VH FR3
RFTISVDKAKSSAYLQLNSLRAEDTAVYYCAT

SEQ ID NO: 785 - protein, 32 aa, Artificial Sequence
  Description of Artificial Sequence: Synthetic humanized antibody 76E1-huVH3 VH FR3
RFTISVDKAKSSLYMQLNSLRAEDTAVYYCAT

SEQ ID NO: 786 - protein, 32 aa, Artificial Sequence
  Description of Artificial Sequence: Synthetic humanized antibody 76E1-huVH3 VH FR3
RFTISVDKAKNSAYMQLNSLRAEDTAVYYCAT

SEQ ID NO: 787 - protein, 32 aa, Artificial Sequence
  Description of Artificial Sequence: Synthetic humanized antibody 76E1-huVH3 VH FR3
RFTISRDKAKSSAYMQLNSLRAEDTAVYYCAT

SEQ ID NO: 788 - protein, 32 aa, Artificial Sequence
  Description of Artificial Sequence: Synthetic humanized antibody 76E1-huVH3 VH FR3
RATLSVDKASNSAYMQMNSLRAEDTAVYYCAR

SEQ ID NO: 789 - protein, 32 aa, Artificial Sequence
  Description of Artificial Sequence: Synthetic humanized antibody 76E1-huVH3 VH FR3
RATLSVDKASNSAYLQLNSLRAEDTAVYYCAR

SEQ ID NO: 790 - protein, 32 aa, Artificial Sequence
  Description of Artificial Sequence: Synthetic humanized antibody 76E1-huVH3 VH FR3
RATLSVDKASNSAYLQMNSLRAEDTAVYYCAT

SEQ ID NO: 791 - protein, 32 aa, Artificial Sequence
  Description of Artificial Sequence: Synthetic humanized antibody 76E1-huVH3 VH FR3
RATLSVDKASNSLYMQLNSLRAEDTAVYYCAR

SEQ ID NO: 792 - protein, 32 aa, Artificial Sequence
  Description of Artificial Sequence: Synthetic humanized antibody 76E1-huVH3 VH FR3
RATLSVDKASNSLYMQMNSLRAEDTAVYYCAT

SEQ ID NO: 793 - protein, 32 aa, Artificial Sequence
  Description of Artificial Sequence: Synthetic humanized antibody 76E1-huVH3 VH FR3
RATLSVDKASNSLYLQLNSLRAEDTAVYYCAT

SEQ ID NO: 794 - protein, 32 aa, Artificial Sequence
  Description of Artificial Sequence: Synthetic humanized antibody 76E1-huVH3 VH FR3
RATLSVDKAKNSAYMQLNSLRAEDTAVYYCAR

SEQ ID NO: 795 - protein, 32 aa, Artificial Sequence
  Description of Artificial Sequence: Synthetic humanized antibody 76E1-huVH3 VH FR3
RATLSVDKAKNSAYMQMNSLRAEDTAVYYCAT

SEQ ID NO: 796 - protein, 32 aa, Artificial Sequence
  Description of Artificial Sequence: Synthetic humanized antibody 76E1-huVH3 VH FR3
RATLSVDKAKNSAYLQLNSLRAEDTAVYYCAT

SEQ ID NO: 797 - protein, 32 aa, Artificial Sequence
  Description of Artificial Sequence: Synthetic humanized antibody 76E1-huVH3 VH FR3
RATLSVDKAKNSLYMQLNSLRAEDTAVYYCAT

SEQ ID NO: 798 - protein, 32 aa, Artificial Sequence
  Description of Artificial Sequence: Synthetic humanized antibody 76E1-huVH3 VH FR3
RATLSVDNAKSSAYMQLNSLRAEDTAVYYCAR

SEQ ID NO: 799 - protein, 32 aa, Artificial Sequence
  Description of Artificial Sequence: Synthetic humanized antibody 76E1-huVH3 VH FR3
RATLSVDNAKSSAYMQMNSLRAEDTAVYYCAT

SEQ ID NO: 800 - protein, 32 aa, Artificial Sequence
  Description of Artificial Sequence: Synthetic humanized antibody 76E1-huVH3 VH FR3
RATLSVDNAKSSAYLQLNSLRAEDTAVYYCAT

SEQ ID NO: 801 - protein, 32 aa, Artificial Sequence
  Description of Artificial Sequence: Synthetic humanized antibody 76E1-huVH3 VH FR3
RATLSVDNAKSSLYMQLNSLRAEDTAVYYCAT

SEQ ID NO: 802 - protein, 32 aa, Artificial Sequence
  Description of Artificial Sequence: Synthetic humanized antibody 76E1-huVH3 VH FR3
RATLSVDNAKNSAYMQLNSLRAEDTAVYYCAT

SEQ ID NO: 803 - protein, 32 aa, Artificial Sequence
  Description of Artificial Sequence: Synthetic humanized antibody 76E1-huVH3 VH FR3
RATLSRDKAKSSAYMQLNSLRAEDTAVYYCAR

SEQ ID NO: 804 - protein, 32 aa, Artificial Sequence
  Description of Artificial Sequence: Synthetic humanized antibody 76E1-huVH3 VH FR3
RATLSRDKAKSSAYMQMNSLRAEDTAVYYCAT

SEQ ID NO: 805 - protein, 32 aa, Artificial Sequence
  Description of Artificial Sequence: Synthetic humanized antibody 76E1-huVH3 VH FR3
RATLSRDKAKSSAYLQLNSLRAEDTAVYYCAT

SEQ ID NO: 806 - protein, 32 aa, Artificial Sequence
  Description of Artificial Sequence: Synthetic humanized antibody 76E1-huVH3 VH FR3
RATLSRDKAKSSLYMQLNSLRAEDTAVYYCAT

SEQ ID NO: 807 - protein, 32 aa, Artificial Sequence
  Description of Artificial Sequence: Synthetic humanized antibody 76E1-huVH3 VH FR3
RATLSRDKAKNSAYMQLNSLRAEDTAVYYCAT

SEQ ID NO: 808 - protein, 32 aa, Artificial Sequence
  Description of Artificial Sequence: Synthetic humanized antibody 76E1-huVH3 VH FR3
RATLSRDNAKSSAYMQLNSLRAEDTAVYYCAT

SEQ ID NO: 809 - protein, 32 aa, Artificial Sequence
  Description of Artificial Sequence: Synthetic humanized antibody 76E1-huVH3 VH FR3
RATISVDKAKSSAYMQLNSLRAEDTAVYYCAR

SEQ ID NO: 810 - protein, 32 aa, Artificial Sequence
  Description of Artificial Sequence: Synthetic humanized antibody 76E1-huVH3 VH FR3
RATISVDKAKSSAYMQMNSLRAEDTAVYYCAT

SEQ ID NO: 811 - protein, 32 aa, Artificial Sequence
  Description of Artificial Sequence: Synthetic humanized antibody 76E1-huVH3 VH FR3
RATISVDKAKSSAYLQLNSLRAEDTAVYYCAT

SEQ ID NO: 812 - protein, 32 aa, Artificial Sequence
  Description of Artificial Sequence: Synthetic humanized antibody 76E1-huVH3 VH FR3
RATISVDKAKSSLYMQLNSLRAEDTAVYYCAT

SEQ ID NO: 813 - protein, 32 aa, Artificial Sequence
  Description of Artificial Sequence: Synthetic humanized antibody 76E1-huVH3 VH FR3
RATISVDKAKNSAYMQLNSLRAEDTAVYYCAT

SEQ ID NO: 814 - protein, 32 aa, Artificial Sequence
  Description of Artificial Sequence: Synthetic humanized antibody 76E1-huVH3 VH FR3
RATISVDNAKSSAYMQLNSLRAEDTAVYYCAT

SEQ ID NO: 815 - protein, 32 aa, Artificial Sequence
  Description of Artificial Sequence: Synthetic humanized antibody 76E1-huVH3 VH FR3
RATISRDKAKSSAYMQLNSLRAEDTAVYYCAT

SEQ ID NO: 816 - protein, 32 aa, Artificial Sequence
  Description of Artificial Sequence: Synthetic humanized antibody 76E1-huVH3 VH FR3
RFTLSVDKAKSSAYMQLNSLRAEDTAVYYCAR

SEQ ID NO: 817 - protein, 32 aa, Artificial Sequence
  Description of Artificial Sequence: Synthetic humanized antibody 76E1-huVH3 VH FR3
RFTLSVDKAKSSAYMQMNSLRAEDTAVYYCAT

SEQ ID NO: 818 - protein, 32 aa, Artificial Sequence
  Description of Artificial Sequence: Synthetic humanized antibody 76E1-huVH3 VH FR3
RFTLSVDKAKSSAYLQLNSLRAEDTAVYYCAT

SEQ ID NO: 819 - protein, 32 aa, Artificial Sequence
  Description of Artificial Sequence: Synthetic humanized antibody 76E1-huVH3 VH FR3
RFTLSVDKAKSSLYMQLNSLRAEDTAVYYCAT

SEQ ID NO: 820 - protein, 32 aa, Artificial Sequence
  Description of Artificial Sequence: Synthetic humanized antibody 76E1-huVH3 VH FR3
RFTLSVDKAKNSAYMQLNSLRAEDTAVYYCAT

SEQ ID NO: 821 - protein, 32 aa, Artificial Sequence
  Description of Artificial Sequence: Synthetic humanized antibody 76E1-huVH3 VH FR3
RFTLSVDNAKSSAYMQLNSLRAEDTAVYYCAT

SEQ ID NO: 822 - protein, 32 aa, Artificial Sequence
  Description of Artificial Sequence: Synthetic humanized antibody 76E1-huVH3 VH FR3
RFTLSRDKASNSAYMQLNSLRAEDTAVYYCAT

SEQ ID NO: 823 - protein, 32 aa, Artificial Sequence
  Description of Artificial Sequence: Synthetic humanized antibody 76E1-huVH3 VH FR3
RFTISVDKAKSSAYMQLNSLRAEDTAVYYCAT

SEQ ID NO: 824 - protein, 32 aa, Artificial Sequence
  Description of Artificial Sequence: Synthetic humanized antibody 76E1-huVH3 VH FR3
RATLSVDKASNSAYMQLNSLRAEDTAVYYCAR

SEQ ID NO: 825 - protein, 32 aa, Artificial Sequence
  Description of Artificial Sequence: Synthetic humanized antibody 76E1-huVH3 VH FR3
RATLSVDKASNSAYMQMNSLRAEDTAVYYCAT

SEQ ID NO: 826 - protein, 32 aa, Artificial Sequence
  Description of Artificial Sequence: Synthetic humanized antibody 76E1-huVH3 VH FR3
RATLSVDKASNSAYLQLNSLRAEDTAVYYCAT

SEQ ID NO: 827 - protein, 32 aa, Artificial Sequence
  Description of Artificial Sequence: Synthetic humanized antibody 76E1-huVH3 VH FR3
RATLSVDKASNSLYMQLNSLRAEDTAVYYCAT

SEQ ID NO: 828 - protein, 32 aa, Artificial Sequence
  Description of Artificial Sequence: Synthetic humanized antibody 76E1-huVH3 VH FR3
RATLSVDKAKNSAYMQLNSLRAEDTAVYYCAT

SEQ ID NO: 829 - protein, 32 aa, Artificial Sequence
  Description of Artificial Sequence: Synthetic humanized antibody 76E1-huVH3 VH FR3
RATLSVDNAKSSAYMQLNSLRAEDTAVYYCAT

SEQ ID NO: 830 - protein, 32 aa, Artificial Sequence
  Description of Artificial Sequence: Synthetic humanized antibody 76E1-huVH3 VH FR3
RATLSRDKAKSSAYMQLNSLRAEDTAVYYCAT

SEQ ID NO: 831 - protein, 32 aa, Artificial Sequence
  Description of Artificial Sequence: Synthetic humanized antibody 76E1-huVH3 VH FR3
RATISVDKAKSSAYMQLNSLRAEDTAVYYCAT

SEQ ID NO: 832 - protein, 32 aa, Artificial Sequence
  Description of Artificial Sequence: Synthetic humanized antibody 76E1-huVH3 VH FR3
RFTLSVDKAKSSAYMQLNSLRAEDTAVYYCAT

SEQ ID NO: 833 - protein, 32 aa, Artificial Sequence
  Description of Artificial Sequence: Synthetic humanized antibody 76E1-huVH3 VH FR3
RATLSVDKASNSAYMQLNSLRAEDTAVYYCAT

SEQ ID NO: 834 - skipped

SEQ ID NO: 835 - protein, 17 aa, Artificial Sequence
  Description of Artificial Sequence: Synthetic humanized antibody 76E1-huVH3 VH CDR2
NIDPYYDYTSYADSVKG

SEQ ID NO: 836 - protein, 17 aa, Artificial Sequence
  Description of Artificial Sequence: Synthetic humanized antibody 76E1-huVH3 VH CDR2
NIEPYYDYTSYADSVKG

SEQ ID NO: 837 - protein, 17 aa, Artificial Sequence
  Description of Artificial Sequence: Synthetic humanized antibody 76E1-huVH3 VH CDR2
NISPYYDYTSYADSVKG

SEQ ID NO: 838 - protein, 17 aa, Artificial Sequence
  Description of Artificial Sequence: Synthetic humanized antibody 76E1-huVH3 VH CDR2
NIAPYYDYTSYADSVKG

SEQ ID NO: 839 - protein, 17 aa, Artificial Sequence
  Description of Artificial Sequence: Synthetic humanized antibody 76E1-huVH3 VH CDR2
NIDPYYDYTSYADSVKG

SEQ ID NO: 840 - protein, 17 aa, Artificial Sequence
  Description of Artificial Sequence: Synthetic humanized antibody 76E1-huVH3 VH CDR2
NIEPYYDYTSYADSVKG

SEQ ID NO: 841 - protein, 17 aa, Artificial Sequence
  Description of Artificial Sequence: Synthetic humanized antibody 76E1-huVH3 VH CDR2
NISPYYDYTSYADSVKG

SEQ ID NO: 842 - protein, 17 aa, Artificial Sequence
  Description of Artificial Sequence: Synthetic humanized antibody 76E1-huVH3 VH CDR2
NIAPYYDYTSYADSVKG

SEQ ID NO: 843 - protein, 7 aa, Artificial Sequence
  Description of Artificial Sequence: Synthetic humanized antibody 76E1-huVK2 VL CDR2
KVSQRFS

SEQ ID NO: 844 - protein, 7 aa, Artificial Sequence
  Description of Artificial Sequence: Synthetic humanized antibody 76E1-huVK2 VL CDR2
KVSSRFS

SEQ ID NO: 845 - protein, 7 aa, Artificial Sequence
  Description of Artificial Sequence: Synthetic humanized antibody 76E1-huVK2 VL CDR2
KVSDRFS

SEQ ID NO: 846 - protein, 7 aa, Artificial Sequence
  Description of Artificial Sequence: Synthetic humanized antibody 76E1-huVK2 VL CDR2
KVSARFS

SEQ ID NO: 847 - protein, 17 aa, Artificial Sequence
  Description of Artificial Sequence: Synthetic humanized antibody 141A-huVH3a VH CDR2
EILPGSGSTQYNEKFKG

SEQ ID NO: 848 - protein, 17 aa, Artificial Sequence
  Description of Artificial Sequence: Synthetic humanized antibody 141A-huVH3a VH CDR2
EILPGSGSTSYNEKFKG

SEQ ID NO: 849 - protein, 17 aa, Artificial Sequence
  Description of Artificial Sequence: Synthetic humanized antibody 141A-huVH3a VH CDR2
EILPGSGSTDYNEKFKG

SEQ ID NO: 850 - protein, 17 aa, Artificial Sequence
  Description of Artificial Sequence: Synthetic humanized antibody 141A-huVH3a VH CDR2
EILPGSGSTAYNEKFKG

SEQ ID NO: 851 - protein, 17 aa, Artificial Sequence
  Description of Artificial Sequence: Synthetic humanized antibody 141A-huVH3a VH CDR2
EILPGSGSTNYQEKFKG

SEQ ID NO: 852 - protein, 17 aa, Artificial Sequence
  Description of Artificial Sequence: Synthetic humanized antibody 141A-huVH3a VH CDR2
EILPGSGSTNYSEKFKG

SEQ ID NO: 853 - protein, 17 aa, Artificial Sequence
  Description of Artificial Sequence: Synthetic humanized antibody 141A-huVH3a VH CDR2
EILPGSGSTNYDEKFKG

SEQ ID NO: 854 - protein, 17 aa, Artificial Sequence
  Description of Artificial Sequence: Synthetic humanized antibody 141A-huVH3a VH CDR2
EILPGSGSTNYAEKFKG

SEQ ID NO: 855 - protein, 17 aa, Artificial Sequence
  Description of Artificial Sequence: Synthetic humanized antibody 141A-huVH3a VH CDR2
EILPGSGSTQYQEKFKG

SEQ ID NO: 856 - protein, 17 aa, Artificial Sequence
  Description of Artificial Sequence: Synthetic humanized antibody 141A-huVH3a VH CDR2
EILPGSGSTSYSEKFKG

SEQ ID NO: 857 - protein, 17 aa, Artificial Sequence
  Description of Artificial Sequence: Synthetic humanized antibody 141A-huVH3a VH CDR2
EILPGSGSTDYDEKFKG

SEQ ID NO: 858 - protein, 17 aa, Artificial Sequence
  Description of Artificial Sequence: Synthetic humanized antibody 141A-huVH3a VH CDR2
EILPGSGSTAYAEKFKG

SEQ ID NO: 859 - protein, 32 aa, Artificial Sequence
  Description of Artificial Sequence: Synthetic humanized antibody 141A-huVH1 VH FR3
RVTMTTDTNTSTAYMELRSLRSDDTAVYYCAR

SEQ ID NO: 860 - protein, 32 aa, Artificial Sequence
  Description of Artificial Sequence: Synthetic humanized antibody 141A-huVH1 VH FR3
RVTMTTDTSTSTAYMELRSLRSDDTAVYYCAG

SEQ ID NO: 861 - protein, 32 aa, Artificial Sequence
  Description of Artificial Sequence: Synthetic humanized antibody 141A-huVH1 VH FR3
RATMTTDTNTSTAYMELRSLRSDDTAVYYCAR

SEQ ID NO: 862 - protein, 32 aa, Artificial Sequence
  Description of Artificial Sequence: Synthetic humanized antibody 141A-huVH1 VH FR3
RATMTTDTSTSTAYMELRSLRSDDTAVYYCAG

SEQ ID NO: 863 - protein, 32 aa, Artificial Sequence
  Description of Artificial Sequence: Synthetic humanized antibody 141A-huVH1 VH FR3
RVTFTTDTNTSTAYMELRSLRSDDTAVYYCAR

SEQ ID NO: 864 - protein, 32 aa, Artificial Sequence
  Description of Artificial Sequence: Synthetic humanized antibody 141A-huVH1 VH FR3
RVTFTTDTSTSTAYMELRSLRSDDTAVYYCAG

SEQ ID NO: 865 - protein, 32 aa, Artificial Sequence
  Description of Artificial Sequence: Synthetic humanized antibody 141A-huVH1 VH FR3
RVTMTADTNTSTAYMELRSLRSDDTAVYYCAR

SEQ ID NO: 866 - protein, 32 aa, Artificial Sequence
  Description of Artificial Sequence: Synthetic humanized antibody 141A-huVH1 VH FR3
RVTMTADTSTSTAYMELRSLRSDDTAVYYCAG

SEQ ID NO: 867 - protein, 32 aa, Artificial Sequence
  Description of Artificial Sequence: Synthetic humanized antibody 141A-huVH1 VH FR3
RVTMTTDTNTSTAYMELRSLRSDDTAVYYCAG

SEQ ID NO: 868 - protein, 32 aa, Artificial Sequence
  Description of Artificial Sequence: Synthetic humanized antibody 141A-huVH1 VH FR3
RATFTTDTNTSTAYMELRSLRSDDTAVYYCAR

SEQ ID NO: 869 - protein, 32 aa, Artificial Sequence
  Description of Artificial Sequence: Synthetic humanized antibody 141A-huVH1 VH FR3
RATFTTDTSTSTAYMELRSLRSDDTAVYYCAG

SEQ ID NO: 870 - protein, 32 aa, Artificial Sequence
  Description of Artificial Sequence: Synthetic humanized antibody 141A-huVH1 VH FR3
RATMTADTNTSTAYMELRSLRSDDTAVYYCAR

SEQ ID NO: 871 - protein, 32 aa, Artificial Sequence
  Description of Artificial Sequence: Synthetic humanized antibody 141A-huVH1 VH FR3
RATMTADTSTSTAYMELRSLRSDDTAVYYCAG

SEQ ID NO: 872 - protein, 32 aa, Artificial Sequence
  Description of Artificial Sequence: Synthetic humanized antibody 141A-huVH1 VH FR3
RATMTTDTNTSTAYMELRSLRSDDTAVYYCAG

SEQ ID NO: 873 - protein, 32 aa, Artificial Sequence
  Description of Artificial Sequence: Synthetic humanized antibody 141A-huVH1 VH FR3
RVTFTADTNTSTAYMELRSLRSDDTAVYYCAR

SEQ ID NO: 874 - protein, 32 aa, Artificial Sequence
  Description of Artificial Sequence: Synthetic humanized antibody 141A-huVH1 VH FR3
RVTFTADTSTSTAYMELRSLRSDDTAVYYCAG

SEQ ID NO: 875 - protein, 32 aa, Artificial Sequence
  Description of Artificial Sequence: Synthetic humanized antibody 141A-huVH1 VH FR3
RVTFTTDTNTSTAYMELRSLRSDDTAVYYCAG

SEQ ID NO: 876 - protein, 32 aa, Artificial Sequence
  Description of Artificial Sequence: Synthetic humanized antibody 141A-huVH1 VH FR3
RVTMTADTNTSTAYMELRSLRSDDTAVYYCAG

SEQ ID NO: 877 - protein, 32 aa, Artificial Sequence
  Description of Artificial Sequence: Synthetic humanized antibody 141A-huVH1 VH FR3
RATFTADTNTSTAYMELRSLRSDDTAVYYCAR

SEQ ID NO: 878 - protein, 32 aa, Artificial Sequence
  Description of Artificial Sequence: Synthetic humanized antibody 141A-huVH1 VH FR3
RATFTADTSTSTAYMELRSLRSDDTAVYYCAG

SEQ ID NO: 879 - protein, 32 aa, Artificial Sequence
  Description of Artificial Sequence: Synthetic humanized antibody 141A-huVH1 VH FR3
RATFTTDTNTSTAYMELRSLRSDDTAVYYCAG

SEQ ID NO: 880 - protein, 32 aa, Artificial Sequence
  Description of Artificial Sequence: Synthetic humanized antibody 141A-huVH1 VH FR3
RATMTADTNTSTAYMELRSLRSDDTAVYYCAG

SEQ ID NO: 881 - protein, 32 aa, Artificial Sequence
  Description of Artificial Sequence: Synthetic humanized antibody 141A-huVH1 VH FR3
RVTFTADTNTSTAYMELRSLRSDDTAVYYCAG

SEQ ID NO: 882 - protein, 32 aa, Artificial Sequence
  Description of Artificial Sequence: Synthetic humanized antibody 141A-huVH1 VH FR3
RATFTADTNTSTAYMELRSLRSDDTAVYYCAG

SEQ ID NO: 883 - protein, 12 aa, Artificial Sequence
  Description of Artificial Sequence: Synthetic humanized antibody 141A-huVH3 VH CDR3
EEVYEGYPWFGY

SEQ ID NO: 884 - protein, 12 aa, Artificial Sequence
  Description of Artificial Sequence: Synthetic humanized antibody 141A-huVH3 VH CDR3
EEVYSGYPWFGY

SEQ ID NO: 885 - protein, 12 aa, Artificial Sequence
  Description of Artificial Sequence: Synthetic humanized antibody 141A-huVH3 VH CDR3
EEVYAGYPWFGY

SEQ ID NO: 886 - protein, 17 aa, Artificial Sequence
  Description of Artificial Sequence: Synthetic humanized antibody 141A-huVH1b VH CDR2
EILPGSGSTQYAQKLQG

SEQ ID NO: 887 - protein, 17 aa, Artificial Sequence
  Description of Artificial Sequence: Synthetic humanized antibody 141A-huVH1b VH CDR2
EILPGSGSTSYAQKLQG

SEQ ID NO: 888 - protein, 17 aa, Artificial Sequence
  Description of Artificial Sequence: Synthetic humanized antibody 141A-huVH1b VH CDR2
EILPGSGSTDYAQKLQG

SEQ ID NO: 889 - protein, 17 aa, Artificial Sequence
  Description of Artificial Sequence: Synthetic humanized antibody 141A-huVH1b VH CDR2
EILPGSGSTAYAQKLQG

SEQ ID NO: 890 - protein, 17 aa, Artificial Sequence
  Description of Artificial Sequence: Synthetic humanized antibody 141A-huVH1b VH CDR2
EILPGSGSTNYAQKFQG

SEQ ID NO: 891 - protein, 17 aa, Artificial Sequence
  Description of Artificial Sequence: Synthetic humanized antibody 141A-huVH1b VH CDR2
EILPGSGSTQYAQKFQG

SEQ ID NO: 892 - protein, 17 aa, Artificial Sequence
  Description of Artificial Sequence: Synthetic humanized antibody 141A-huVH1b VH CDR2
EILPGSGSTSYAQKFQG

SEQ ID NO: 893 - protein, 17 aa, Artificial Sequence
  Description of Artificial Sequence: Synthetic humanized antibody 141A-huVH1b VH CDR2
EILPGSGSTDYAQKFQG

SEQ ID NO: 894 - protein, 17 aa, Artificial Sequence
  Description of Artificial Sequence: Synthetic humanized antibody 141A-huVH1b VH CDR2
EILPGSGSTAYAQKFQG

SEQ ID NO: 895 - protein, 25 aa, Artificial Sequence
  Description of Artificial Sequence: Synthetic humanized antibody 141A-huVH3 VH FR1
EVQLVESGGGLMQPGGSLRLSCAAS

SEQ ID NO: 896 - protein, 25 aa, Artificial Sequence
  Description of Artificial Sequence: Synthetic humanized antibody 141A-huVH3 VH FR1
EVQLVQSGGGLMQPGGSLRLSCAAS

SEQ ID NO: 897 - protein, 25 aa, Artificial Sequence
  Description of Artificial Sequence: Synthetic humanized antibody 141A-huVH3 VH FR1
EVQLVESGGGLMQPGGSVRLSCAAS

SEQ ID NO: 898 - protein, 25 aa, Artificial Sequence
  Description of Artificial Sequence: Synthetic humanized antibody 141A-huVH3 VH FR1
EVQLVESGGGLMQPGGSLRISCAAS

SEQ ID NO: 899 - protein, 25 aa, Artificial Sequence
  Description of Artificial Sequence: Synthetic humanized antibody 141A-huVH3 VH FR1
EVQLVQSGGGLMQPGGSVRLSCAAS

SEQ ID NO: 900 - protein, 25 aa, Artificial Sequence
  Description of Artificial Sequence: Synthetic humanized antibody 141A-huVH3 VH FR1
EVQLVQSGGGLMQPGGSLRISCAAS

SEQ ID NO: 901 - protein, 25 aa, Artificial Sequence
  Description of Artificial Sequence: Synthetic humanized antibody 141A-huVH3 VH FR1
EVQLVESGGGLMQPGGSVRISCAAS

SEQ ID NO: 902 - protein, 25 aa, Artificial Sequence
  Description of Artificial Sequence: Synthetic humanized antibody 141A-huVH3 VH FR1
EVQLVQSGGGLMQPGGSVRISCAAS

SEQ ID NO: 903 - protein, 32 aa, Artificial Sequence
  Description of Artificial Sequence: Synthetic humanized antibody 141A-huVH3 VH FR3
RFTISRDNAKNSLYLQMNSLRAEDTAVYYCAG

SEQ ID NO: 904 - protein, 32 aa, Artificial Sequence
  Description of Artificial Sequence: Synthetic humanized antibody 141A-huVH3 VH FR3
RATISRDNAKNSLYLQMNSLRAEDTAVYYCAG

SEQ ID NO: 905 - protein, 32 aa, Artificial Sequence
  Description of Artificial Sequence: Synthetic humanized antibody 141A-huVH3 VH FR3
RFTFSRDNAKNSLYLQMNSLRAEDTAVYYCAG

SEQ ID NO: 906 - protein, 32 aa, Artificial Sequence
  Description of Artificial Sequence: Synthetic humanized antibody 141A-huVH3 VH FR3
RFTISADNAKNSLYLQMNSLRAEDTAVYYCAG

SEQ ID NO: 907 - protein, 32 aa, Artificial Sequence
  Description of Artificial Sequence: Synthetic humanized antibody 141A-huVH3 VH FR3
RFTISRDTAKNSLYLQMNSLRAEDTAVYYCAG

SEQ ID NO: 908 - protein, 32 aa, Artificial Sequence
  Description of Artificial Sequence: Synthetic humanized antibody 141A-huVH3 VH FR3
RFTISRDNAKNSAYLQMNSLRAEDTAVYYCAG

SEQ ID NO: 909 - protein, 32 aa, Artificial Sequence
  Description of Artificial Sequence: Synthetic humanized antibody 141A-huVH3 VH FR3
RFTISRDNAKNSLYMQMNSLRAEDTAVYYCAG

SEQ ID NO: 910 - protein, 32 aa, Artificial Sequence
  Description of Artificial Sequence: Synthetic humanized antibody 141A-huVH3 VH FR3
RFTISRDNAKNSLYLQLNSLRAEDTAVYYCAG

SEQ ID NO: 911 - protein, 32 aa, Artificial Sequence
  Description of Artificial Sequence: Synthetic humanized antibody 141A-huVH3 VH FR3
RATFSRDNAKNSLYLQMNSLRAEDTAVYYCAG

SEQ ID NO: 912 - protein, 32 aa, Artificial Sequence
  Description of Artificial Sequence: Synthetic humanized antibody 141A-huVH3 VH FR3
RATISADNAKNSLYLQMNSLRAEDTAVYYCAG

SEQ ID NO: 913 - protein, 32 aa, Artificial Sequence
  Description of Artificial Sequence: Synthetic humanized antibody 141A-huVH3 VH FR3
RATISRDTAKNSLYLQMNSLRAEDTAVYYCAG

SEQ ID NO: 914 - protein, 32 aa, Artificial Sequence
  Description of Artificial Sequence: Synthetic humanized antibody 141A-huVH3 VH FR3
RATISRDNAKNSAYLQMNSLRAEDTAVYYCAG

SEQ ID NO: 915 - protein, 32 aa, Artificial Sequence
  Description of Artificial Sequence: Synthetic humanized antibody 141A-huVH3 VH FR3
RATISRDNAKNSLYMQMNSLRAEDTAVYYCAG

SEQ ID NO: 916 - protein, 32 aa, Artificial Sequence
  Description of Artificial Sequence: Synthetic humanized antibody 141A-huVH3 VH FR3
RATISRDNAKNSLYLQLNSLRAEDTAVYYCAG

SEQ ID NO: 917 - protein, 32 aa, Artificial Sequence
  Description of Artificial Sequence: Synthetic humanized antibody 141A-huVH3 VH FR3
RFTFSADNAKNSLYLQMNSLRAEDTAVYYCAG

SEQ ID NO: 918 - protein, 32 aa, Artificial Sequence
  Description of Artificial Sequence: Synthetic humanized antibody 141A-huVH3 VH FR3
RFTFSRDTAKNSLYLQMNSLRAEDTAVYYCAG

SEQ ID NO: 919 - protein, 32 aa, Artificial Sequence
  Description of Artificial Sequence: Synthetic humanized antibody 141A-huVH3 VH FR3
RFTFSRDNAKNSAYLQMNSLRAEDTAVYYCAG

SEQ ID NO: 920 - protein, 32 aa, Artificial Sequence
  Description of Artificial Sequence: Synthetic humanized antibody 141A-huVH3 VH FR3
RFTFSRDNAKNSLYMQMNSLRAEDTAVYYCAG

SEQ ID NO: 921 - protein, 32 aa, Artificial Sequence
  Description of Artificial Sequence: Synthetic humanized antibody 141A-huVH3 VH FR3
RFTFSRDNAKNSLYLQLNSLRAEDTAVYYCAG

SEQ ID NO: 922 - protein, 32 aa, Artificial Sequence
  Description of Artificial Sequence: Synthetic humanized antibody 141A-huVH3 VH FR3
RFTISADTAKNSLYLQMNSLRAEDTAVYYCAG

SEQ ID NO: 923 - protein, 32 aa, Artificial Sequence
  Description of Artificial Sequence: Synthetic humanized antibody 141A-huVH3 VH FR3
RFTISADNAKNSAYLQMNSLRAEDTAVYYCAG

SEQ ID NO: 924 - protein, 32 aa, Artificial Sequence
  Description of Artificial Sequence: Synthetic humanized antibody 141A-huVH3 VH FR3
RFTISADNAKNSLYMQMNSLRAEDTAVYYCAG

SEQ ID NO: 925 - protein, 32 aa, Artificial Sequence
  Description of Artificial Sequence: Synthetic humanized antibody 141A-huVH3 VH FR3
RFTISADNAKNSLYLQLNSLRAEDTAVYYCAG

SEQ ID NO: 926 - protein, 32 aa, Artificial Sequence
  Description of Artificial Sequence: Synthetic humanized antibody 141A-huVH3 VH FR3
RFTISRDTAKNSAYLQMNSLRAEDTAVYYCAG

SEQ ID NO: 927 - protein, 32 aa, Artificial Sequence
  Description of Artificial Sequence: Synthetic humanized antibody 141A-huVH3 VH FR3
RFTISRDTAKNSLYMQMNSLRAEDTAVYYCAG

SEQ ID NO: 928 - protein, 32 aa, Artificial Sequence
  Description of Artificial Sequence: Synthetic humanized antibody 141A-huVH3 VH FR3
RFTISRDTAKNSLYLQLNSLRAEDTAVYYCAG

SEQ ID NO: 929 - protein, 32 aa, Artificial Sequence
  Description of Artificial Sequence: Synthetic humanized antibody 141A-huVH3 VH FR3
RFTISRDNAKNSAYMQMNSLRAEDTAVYYCAG

SEQ ID NO: 930 - protein, 32 aa, Artificial Sequence
  Description of Artificial Sequence: Synthetic humanized antibody 141A-huVH3 VH FR3
RFTISRDNAKNSAYLQLNSLRAEDTAVYYCAG

SEQ ID NO: 931 - protein, 32 aa, Artificial Sequence
  Description of Artificial Sequence: Synthetic humanized antibody 141A-huVH3 VH FR3
RFTISRDNAKNSLYMQLNSLRAEDTAVYYCAG

SEQ ID NO: 932 - protein, 32 aa, Artificial Sequence
  Description of Artificial Sequence: Synthetic humanized antibody 141A-huVH3 VH FR3
RATFSADNAKNSLYLQMNSLRAEDTAVYYCAG

SEQ ID NO: 933 - protein, 32 aa, Artificial Sequence
  Description of Artificial Sequence: Synthetic humanized antibody 141A-huVH3 VH FR3
RATFSRDTAKNSLYLQMNSLRAEDTAVYYCAG

SEQ ID NO: 934 - protein, 32 aa, Artificial Sequence
  Description of Artificial Sequence: Synthetic humanized antibody 141A-huVH3 VH FR3
RATFSRDNAKNSAYLQMNSLRAEDTAVYYCAG

SEQ ID NO: 935 - protein, 32 aa, Artificial Sequence
  Description of Artificial Sequence: Synthetic humanized antibody 141A-huVH3 VH FR3
RATFSRDNAKNSLYMQMNSLRAEDTAVYYCAG

SEQ ID NO: 936 - protein, 32 aa, Artificial Sequence
  Description of Artificial Sequence: Synthetic humanized antibody 141A-huVH3 VH FR3
RATFSRDNAKNSLYLQLNSLRAEDTAVYYCAG

SEQ ID NO: 937 - protein, 32 aa, Artificial Sequence
  Description of Artificial Sequence: Synthetic humanized antibody 141A-huVH3 VH FR3
RATISADTAKNSLYLQMNSLRAEDTAVYYCAG

SEQ ID NO: 938 - protein, 32 aa, Artificial Sequence
  Description of Artificial Sequence: Synthetic humanized antibody 141A-huVH3 VH FR3
RATISADNAKNSAYLQMNSLRAEDTAVYYCAG

SEQ ID NO: 939 - protein, 32 aa, Artificial Sequence
  Description of Artificial Sequence: Synthetic humanized antibody 141A-huVH3 VH FR3
RATISADNAKNSLYMQMNSLRAEDTAVYYCAG

SEQ ID NO: 940 - protein, 32 aa, Artificial Sequence
  Description of Artificial Sequence: Synthetic humanized antibody 141A-huVH3 VH FR3
RATISADNAKNSLYLQLNSLRAEDTAVYYCAG

SEQ ID NO: 941 - protein, 32 aa, Artificial Sequence
  Description of Artificial Sequence: Synthetic humanized antibody 141A-huVH3 VH FR3
RATISRDTAKNSAYLQMNSLRAEDTAVYYCAG

SEQ ID NO: 942 - protein, 32 aa, Artificial Sequence
  Description of Artificial Sequence: Synthetic humanized antibody 141A-huVH3 VH FR3
RATISRDTAKNSLYMQMNSLRAEDTAVYYCAG

SEQ ID NO: 943 - protein, 32 aa, Artificial Sequence
  Description of Artificial Sequence: Synthetic humanized antibody 141A-huVH3 VH FR3
RATISRDTAKNSLYLQLNSLRAEDTAVYYCAG

SEQ ID NO: 944 - protein, 32 aa, Artificial Sequence
  Description of Artificial Sequence: Synthetic humanized antibody 141A-huVH3 VH FR3
RATISRDNAKNSAYMQMNSLRAEDTAVYYCAG

SEQ ID NO: 945 - protein, 32 aa, Artificial Sequence
  Description of Artificial Sequence: Synthetic humanized antibody 141A-huVH3 VH FR3
RATISRDNAKNSAYLQLNSLRAEDTAVYYCAG

SEQ ID NO: 946 - protein, 32 aa, Artificial Sequence
  Description of Artificial Sequence: Synthetic humanized antibody 141A-huVH3 VH FR3
RATISRDNAKNSLYMQLNSLRAEDTAVYYCAG

SEQ ID NO: 947 - protein, 32 aa, Artificial Sequence
  Description of Artificial Sequence: Synthetic humanized antibody 141A-huVH3 VH FR3
RFTFSADTAKNSLYLQMNSLRAEDTAVYYCAG

SEQ ID NO: 948 - protein, 32 aa, Artificial Sequence
  Description of Artificial Sequence: Synthetic humanized antibody 141A-huVH3 VH FR3
RFTFSADNAKNSAYLQMNSLRAEDTAVYYCAG

SEQ ID NO: 949 - protein, 32 aa, Artificial Sequence
  Description of Artificial Sequence: Synthetic humanized antibody 141A-huVH3 VH FR3
RFTFSADNAKNSLYMQMNSLRAEDTAVYYCAG

SEQ ID NO: 950 - protein, 32 aa, Artificial Sequence
  Description of Artificial Sequence: Synthetic humanized antibody 141A-huVH3 VH FR3
RFTFSADNAKNSLYLQLNSLRAEDTAVYYCAG

SEQ ID NO: 951 - protein, 32 aa, Artificial Sequence
  Description of Artificial Sequence: Synthetic humanized antibody 141A-huVH3 VH FR3
RFTFSRDTAKNSAYLQMNSLRAEDTAVYYCAG

SEQ ID NO: 952 - protein, 32 aa, Artificial Sequence
  Description of Artificial Sequence: Synthetic humanized antibody 141A-huVH3 VH FR3
RFTFSRDTAKNSLYMQMNSLRAEDTAVYYCAG

SEQ ID NO: 953 - protein, 32 aa, Artificial Sequence
  Description of Artificial Sequence: Synthetic humanized antibody 141A-huVH3 VH FR3
RFTFSRDTAKNSLYLQLNSLRAEDTAVYYCAG

SEQ ID NO: 954 - protein, 32 aa, Artificial Sequence
  Description of Artificial Sequence: Synthetic humanized antibody 141A-huVH3 VH FR3
RFTFSRDNAKNSAYMQMNSLRAEDTAVYYCAG

SEQ ID NO: 955 - protein, 32 aa, Artificial Sequence
  Description of Artificial Sequence: Synthetic humanized antibody 141A-huVH3 VH FR3
RFTFSRDNAKNSAYLQLNSLRAEDTAVYYCAG

SEQ ID NO: 956 - protein, 32 aa, Artificial Sequence
  Description of Artificial Sequence: Synthetic humanized antibody 141A-huVH3 VH FR3
RFTFSRDNAKNSLYMQLNSLRAEDTAVYYCAG

SEQ ID NO: 957 - protein, 32 aa, Artificial Sequence
  Description of Artificial Sequence: Synthetic humanized antibody 141A-huVH3 VH FR3
RFTISADTAKNSAYLQMNSLRAEDTAVYYCAG

SEQ ID NO: 958 - protein, 32 aa, Artificial Sequence
  Description of Artificial Sequence: Synthetic humanized antibody 141A-huVH3 VH FR3
RFTISADTAKNSLYMQMNSLRAEDTAVYYCAG

SEQ ID NO: 959 - protein, 32 aa, Artificial Sequence
  Description of Artificial Sequence: Synthetic humanized antibody 141A-huVH3 VH FR3
RFTISADTAKNSLYLQLNSLRAEDTAVYYCAG

SEQ ID NO: 960 - protein, 32 aa, Artificial Sequence
  Description of Artificial Sequence: Synthetic humanized antibody 141A-huVH3 VH FR3
RFTISADNAKNSAYMQMNSLRAEDTAVYYCAG

SEQ ID NO: 961 - protein, 32 aa, Artificial Sequence
  Description of Artificial Sequence: Synthetic humanized antibody 141A-huVH3 VH FR3
RFTISADNAKNSAYLQLNSLRAEDTAVYYCAG

SEQ ID NO: 962 - protein, 32 aa, Artificial Sequence
  Description of Artificial Sequence: Synthetic humanized antibody 141A-huVH3 VH FR3
RFTISADNAKNSLYMQLNSLRAEDTAVYYCAG

SEQ ID NO: 963 - protein, 32 aa, Artificial Sequence
  Description of Artificial Sequence: Synthetic humanized antibody 141A-huVH3 VH FR3
RFTISRDTAKNSAYMQMNSLRAEDTAVYYCAG

SEQ ID NO: 964 - protein, 32 aa, Artificial Sequence
  Description of Artificial Sequence: Synthetic humanized antibody 141A-huVH3 VH FR3
RFTISRDTAKNSAYLQLNSLRAEDTAVYYCAG

SEQ ID NO: 965 - protein, 32 aa, Artificial Sequence
  Description of Artificial Sequence: Synthetic humanized antibody 141A-huVH3 VH FR3
RFTISRDTAKNSLYMQLNSLRAEDTAVYYCAG

SEQ ID NO: 966 - protein, 32 aa, Artificial Sequence
  Description of Artificial Sequence: Synthetic humanized antibody 141A-huVH3 VH FR3
RFTISRDNAKNSAYMQLNSLRAEDTAVYYCAG

SEQ ID NO: 967 - protein, 32 aa, Artificial Sequence
  Description of Artificial Sequence: Synthetic humanized antibody 141A-huVH3 VH FR3
RATFSADTAKNSLYLQMNSLRAEDTAVYYCAG

SEQ ID NO: 968 - protein, 32 aa, Artificial Sequence
  Description of Artificial Sequence: Synthetic humanized antibody 141A-huVH3 VH FR3
RATFSADNAKNSAYLQMNSLRAEDTAVYYCAG

SEQ ID NO: 969 - protein, 32 aa, Artificial Sequence
  Description of Artificial Sequence: Synthetic humanized antibody 141A-huVH3 VH FR3
RATFSADNAKNSLYMQMNSLRAEDTAVYYCAG

SEQ ID NO: 970 - protein, 32 aa, Artificial Sequence
  Description of Artificial Sequence: Synthetic humanized antibody 141A-huVH3 VH FR3
RATFSADNAKNSLYLQLNSLRAEDTAVYYCAG

SEQ ID NO: 971 - protein, 32 aa, Artificial Sequence
  Description of Artificial Sequence: Synthetic humanized antibody 141A-huVH3 VH FR3
RATFSRDTAKNSAYLQMNSLRAEDTAVYYCAG

SEQ ID NO: 972 - protein, 32 aa, Artificial Sequence
  Description of Artificial Sequence: Synthetic humanized antibody 141A-huVH3 VH FR3
RATFSRDTAKNSLYMQMNSLRAEDTAVYYCAG

SEQ ID NO: 973 - protein, 32 aa, Artificial Sequence
  Description of Artificial Sequence: Synthetic humanized antibody 141A-huVH3 VH FR3
RATFSRDTAKNSLYLQLNSLRAEDTAVYYCAG

SEQ ID NO: 974 - protein, 32 aa, Artificial Sequence
  Description of Artificial Sequence: Synthetic humanized antibody 141A-huVH3 VH FR3
RATFSRDNAKNSAYMQMNSLRAEDTAVYYCAG

SEQ ID NO: 975 - protein, 32 aa, Artificial Sequence
  Description of Artificial Sequence: Synthetic humanized antibody 141A-huVH3 VH FR3
RATFSRDNAKNSAYLQLNSLRAEDTAVYYCAG

SEQ ID NO: 976 - protein, 32 aa, Artificial Sequence
  Description of Artificial Sequence: Synthetic humanized antibody 141A-huVH3 VH FR3
RATFSRDNAKNSLYMQLNSLRAEDTAVYYCAG

SEQ ID NO: 977 - protein, 32 aa, Artificial Sequence
  Description of Artificial Sequence: Synthetic humanized antibody 141A-huVH3 VH FR3
RATISADTAKNALYLQMNSLRAEDTAVYYCAG

SEQ ID NO: 978 - protein, 32 aa, Artificial Sequence
  Description of Artificial Sequence: Synthetic humanized antibody 141A-huVH3 VH FR3
RATISADTAKNSLYMQMNSLRAEDTAVYYCAG

SEQ ID NO: 979 - protein, 32 aa, Artificial Sequence
  Description of Artificial Sequence: Synthetic humanized antibody 141A-huVH3 VH FR3
RATISADTAKNSLYLQLNSLRAEDTAVYYCAG

SEQ ID NO: 980 - protein, 32 aa, Artificial Sequence
  Description of Artificial Sequence: Synthetic humanized antibody 141A-huVH3 VH FR3
RATISADNAKNSAYMQMNSLRAEDTAVYYCAG

SEQ ID NO: 981 - protein, 32 aa, Artificial Sequence
  Description of Artificial Sequence: Synthetic humanized antibody 141A-huVH3 VH FR3
RATISADNAKNSAYLQLNSLRAEDTAVYYCAG

SEQ ID NO: 982 - protein, 32 aa, Artificial Sequence
  Description of Artificial Sequence: Synthetic humanized antibody 141A-huVH3 VH FR3
RATISADNAKNSLYMQLNSLRAEDTAVYYCAG

SEQ ID NO: 983 - protein, 32 aa, Artificial Sequence
  Description of Artificial Sequence: Synthetic humanized antibody 141A-huVH3 VH FR3
RATISRDTAKNSAYMQMNSLRAEDTAVYYCAG

SEQ ID NO: 984 - protein, 32 aa, Artificial Sequence
  Description of Artificial Sequence: Synthetic 141A-huVH3 VH FR3 humanized antibody
RATISRDTAKNSAYLQLNSLRAEDTAVYYCAG

SEQ ID NO: 985 - protein, 32 aa, Artificial Sequence
  Description of Artificial Sequence: Synthetic humanized antibody 141A-huVH3 VH FR3
RATISRDTAKNSLYMQLNSLRAEDTAVYYCAG

SEQ ID NO: 986 - protein, 32 aa, Artificial Sequence
  Description of Artificial Sequence: Synthetic humanized antibody 141A-huVH3 VH FR3
RATISRDNAKNSAYMQLNSLRAEDTAVYYCAG

SEQ ID NO: 987 - protein, 32 aa, Artificial Sequence
  Description of Artificial Sequence: Synthetic humanized antibody 141A-huVH3 VH FR3
RFTFSADTAKNSAYLQMNSLRAEDTAVYYCAG

SEQ ID NO: 988 - protein, 32 aa, Artificial Sequence
  Description of Artificial Sequence: Synthetic humanized antibody 141A-huVH3 VH FR3
RFTFSADTAKNSLYMQMNSLRAEDTAVYYCAG

SEQ ID NO: 989 - protein, 32 aa, Artificial Sequence
  Description of Artificial Sequence: Synthetic humanized antibody 141A-huVH3 VH FR3
RFTFSADTAKNSLYLQLNSLRAEDTAVYYCAG

SEQ ID NO: 990 - protein, 32 aa, Artificial Sequence
  Description of Artificial Sequence: Synthetic humanized antibody 141A-huVH3 VH FR3
RFTFSADNAKNSAYMQMNSLRAEDTAVYYCAG

SEQ ID NO: 991 - protein, 32 aa, Artificial Sequence
  Description of Artificial Sequence: Synthetic humanized antibody 141A-huVH3 VH FR3
RFTFSADNAKNSAYLQLNSLRAEDTAVYYCAG

SEQ ID NO: 992 - protein, 32 aa, Artificial Sequence
  Description of Artificial Sequence: Synthetic humanized antibody 141A-huVH3 VH FR3
RFTFSADNAKNSLYMQLNSLRAEDTAVYYCAG

SEQ ID NO: 993 - protein, 32 aa, Artificial Sequence
  Description of Artificial Sequence: Synthetic humanized antibody 141A-huVH3 VH FR3
RFTFSRDTAKNSAYMQMNSLRAEDTAVYYCAG

SEQ ID NO: 994 - protein, 32 aa, Artificial Sequence
  Description of Artificial Sequence: Synthetic humanized antibody 141A-huVH3 VH FR3
RFTFSRDTAKNSAYLQLNSLRAEDTAVYYCAG

SEQ ID NO: 995 - protein, 32 aa, Artificial Sequence
  Description of Artificial Sequence: Synthetic humanized antibody 141A-huVH3 VH FR3
RFTFSRDTAKNSLYMQLNSLRAEDTAVYYCAG

SEQ ID NO: 996 - protein, 32 aa, Artificial Sequence
  Description of Artificial Sequence: Synthetic humanized antibody 141A-huVH3 VH FR3
RFTFSRDNAKNSAYMQLNSLRAEDTAVYYCAG

SEQ ID NO: 997 - protein, 32 aa, Artificial Sequence
  Description of Artificial Sequence: Synthetic humanized antibody 141A-huVH3 VH FR3
RFTISADTAKNSAYMQMNSLRAEDTAVYYCAG

SEQ ID NO: 998 - protein, 32 aa, Artificial Sequence
  Description of Artificial Sequence: Synthetic humanized antibody 141A-huVH3 VH FR3
RFTISADTAKNSAYLQLNSLRAEDTAVYYCAG

SEQ ID NO: 999 - protein, 32 aa, Artificial Sequence
  Description of Artificial Sequence: Synthetic humanized antibody 141A-huVH3 VH FR3
RFTISADTAKNSLYMQLNSLRAEDTAVYYCAG

SEQ ID NO: 1000 - protein, 32 aa, Artificial Sequence
  Description of Artificial Sequence: Synthetic humanized antibody 141A-huVH3 VH FR3
RFTISADNAKNSAYMQLNSLRAEDTAVYYCAG

SEQ ID NO: 1001 - protein, 32 aa, Artificial Sequence
  Description of Artificial Sequence: Synthetic humanized antibody 141A-huVH3 VH FR3
RFTISRDTAKNSAYMQLNSLRAEDTAVYYCAG

SEQ ID NO: 1002 - protein, 32 aa, Artificial Sequence
  Description of Artificial Sequence: Synthetic humanized antibody 141A-huVH3 VH FR3
RATFSADTAKNSAYLQMNSLRAEDTAVYYCAG

SEQ ID NO: 1003 - protein, 32 aa, Artificial Sequence
  Description of Artificial Sequence: Synthetic humanized antibody 141A-huVH3 VH FR3
RATFSADTAKNSLYMQMNSLRAEDTAVYYCAG

SEQ ID NO: 1004 - protein, 32 aa, Artificial Sequence
  Description of Artificial Sequence: Synthetic humanized antibody 141A-huVH3 VH FR3
RATFSADTAKNSLYLQLNSLRAEDTAVYYCAG

SEQ ID NO: 1005 - protein, 32 aa, Artificial Sequence
  Description of Artificial Sequence: Synthetic humanized antibody 141A-huVH3 VH FR3
RATFSADNAKNSAYMQMNSLRAEDTAVYYCAG

SEQ ID NO: 1006 - protein, 32 aa, Artificial Sequence
  Description of Artificial Sequence: Synthetic humanized antibody 141A-huVH3 VH FR3
RATFSADNAKNSAYLQLNSLRAEDTAVYYCAG

SEQ ID NO: 1007 - protein, 32 aa, Artificial Sequence
  Description of Artificial Sequence: Synthetic humanized antibody 141A-huVH3 VH FR3
RATFSADNAKNSLYMQLNSLRAEDTAVYYCAG

SEQ ID NO: 1008 - protein, 32 aa, Artificial Sequence
  Description of Artificial Sequence: Synthetic humanized antibody 141A-huVH3 VH FR3
RATFSRDTAKNSAYMQMNSLRAEDTAVYYCAG

SEQ ID NO: 1009 - protein, 32 aa, Artificial Sequence
  Description of Artificial Sequence: Synthetic humanized antibody 141A-huVH3 VH FR3
RATFSRDTAKNSAYLQLNSLRAEDTAVYYCAG

SEQ ID NO: 1010 - protein, 32 aa, Artificial Sequence
  Description of Artificial Sequence: Synthetic humanized antibody 141A-huVH3 VH FR3
RATFSRDTAKNSLYMQLNSLRAEDTAVYYCAG

SEQ ID NO: 1011 - protein, 32 aa, Artificial Sequence
  Description of Artificial Sequence: Synthetic humanized antibody 141A-huVH3 VH FR3
RATFSRDNAKNSAYMQLNSLRAEDTAVYYCAG

SEQ ID NO: 1012 - protein, 32 aa, Artificial Sequence
  Description of Artificial Sequence: Synthetic humanized antibody 141A-huVH3 VH FR3
RATISADTAKNALYMQMNSLRAEDTAVYYCAG

SEQ ID NO: 1013 - protein, 32 aa, Artificial Sequence
  Description of Artificial Sequence: Synthetic humanized antibody 141A-huVH3 VH FR3
RATISADTAKNALYLQLNSLRAEDTAVYYCAG

SEQ ID NO: 1014 - protein, 32 aa, Artificial Sequence
  Description of Artificial Sequence: Synthetic humanized antibody 141A-huVH3 VH FR3
RATISADTAKNSLYMQLNSLRAEDTAVYYCAG

SEQ ID NO: 1015 - protein, 32 aa, Artificial Sequence
  Description of Artificial Sequence: Synthetic humanized antibody 141A-huVH3 VH FR3
RATISADNAKNSAYMQLNSLRAEDTAVYYCAG

SEQ ID NO: 1016 - protein, 32 aa, Artificial Sequence
  Description of Artificial Sequence: Synthetic humanized antibody 141A-huVH3 VH FR3
RATISRDTAKNSAYMQLNSLRAEDTAVYYCAG

SEQ ID NO: 1017 - protein, 32 aa, Artificial Sequence
  Description of Artificial Sequence: Synthetic humanized antibody 141A-huVH3 VH FR3
RFTFSADTAKNSAYMQMNSLRAEDTAVYYCAG

SEQ ID NO: 1018 - protein, 32 aa, Artificial Sequence
  Description of Artificial Sequence: Synthetic humanized antibody 141A-huVH3 VH FR3
RFTFSADTAKNSAYLQLNSLRAEDTAVYYCAG

SEQ ID NO: 1019 - protein, 32 aa, Artificial Sequence
  Description of Artificial Sequence: Synthetic humanized antibody 141A-huVH3 VH FR3
RFTFSADTAKNSLYMQLNSLRAEDTAVYYCAG

SEQ ID NO: 1020 - protein, 32 aa, Artificial Sequence
  Description of Artificial Sequence: Synthetic humanized antibody 141A-huVH3 VH FR3
RFTFSADNAKNSAYMQLNSLRAEDTAVYYCAG

SEQ ID NO: 1021 - protein, 32 aa, Artificial Sequence
  Description of Artificial Sequence: Synthetic humanized antibody 141A-huVH3 VH FR3
RFTFSRDTAKNSAYMQLNSLRAEDTAVYYCAG

SEQ ID NO: 1022 - protein, 32 aa, Artificial Sequence
  Description of Artificial Sequence: Synthetic humanized antibody 141A-huVH3 VH FR3
RFTISADTAKNSAYMQLNSLRAEDTAVYYCAG

SEQ ID NO: 1023 - protein, 32 aa, Artificial Sequence
  Description of Artificial Sequence: Synthetic humanized antibody 141A-huVH3 VH FR3
RATFSADTAKNSAYMQMNSLRAEDTAVYYCAG

SEQ ID NO: 1024 - protein, 32 aa, Artificial Sequence
  Description of Artificial Sequence: Synthetic humanized antibody 141A-huVH3 VH FR3
RATFSADTAKNSAYLQLNSLRAEDTAVYYCAG

SEQ ID NO: 1025 - protein, 32 aa, Artificial Sequence
  Description of Artificial Sequence: Synthetic humanized antibody 141A-huVH3 VH FR3
RATFSADTAKNSLYMQLNSLRAEDTAVYYCAG

SEQ ID NO: 1026 - protein, 32 aa, Artificial Sequence
  Description of Artificial Sequence: Synthetic humanized antibody 141A-huVH3 VH FR3
RATFSADNAKNSAYMQLNSLRAEDTAVYYCAG

SEQ ID NO: 1027 - protein, 32 aa, Artificial Sequence
  Description of Artificial Sequence: Synthetic humanized antibody 141A-huVH3 VH FR3
RATFSRDTAKNSAYMQLNSLRAEDTAVYYCAG

SEQ ID NO: 1028 - protein, 32 aa, Artificial Sequence
  Description of Artificial Sequence: Synthetic humanized antibody 141A-huVH3 VH FR3
RATISADTAKNALYMQLNSLRAEDTAVYYCAG

SEQ ID NO: 1029 - protein, 32 aa, Artificial Sequence
  Description of Artificial Sequence: Synthetic humanized antibody 141A-huVH3 VH FR3
RFTFSADTAKNSAYMQLNSLRAEDTAVYYCAG

SEQ ID NO: 1030 - protein, 32 aa, Artificial Sequence
  Description of Artificial Sequence: Synthetic humanized antibody 141A-huVH3 VH FR3
RATFSADTAKNSAYMQLNSLRAEDTAVYYCAG

SEQ ID NO: 1031 - protein, 23 aa, Artificial Sequence
  Description of Artificial Sequence: Synthetic humanized antibody 141A-huVK3 VL FR1
EIVLTQSPGTLSASPGERATLSC

SEQ ID NO: 1032 - protein, 23 aa, Artificial Sequence
  Description of Artificial Sequence: Synthetic humanized antibody 141A-huVK3 VL FR1
EIVLTQSPGTLSLSPGERVTLSC

SEQ ID NO: 1033 - protein, 23 aa, Artificial Sequence
  Description of Artificial Sequence: Synthetic humanized antibody 141A-huVK3 VL FR1
EIVLTQSPGTLSLSPGERATMSC

SEQ ID NO: 1034 - protein, 23 aa, Artificial Sequence
  Description of Artificial Sequence: Synthetic humanized antibody 141A-huVK3 VL FR1
EIVLTQSPGTLSASPGERVTLSC

SEQ ID NO: 1035 - protein, 23 aa, Artificial Sequence
  Description of Artificial Sequence: Synthetic humanized antibody 141A-huVK3 VL FR1
EIVLTQSPGTLSASPGERATMSC

SEQ ID NO: 1036 - protein, 23 aa, Artificial Sequence
  Description of Artificial Sequence: Synthetic humanized antibody 141A-huVK3 VL FR1
EIVLTQSPGTLSLSPGERVTMSC

SEQ ID NO: 1037 - protein, 23 aa, Artificial Sequence
  Description of Artificial Sequence: Synthetic humanized antibody 141A-huVK3 VL FR1
EIVLTQSPGTLSASPGERVTMSC

SEQ ID NO: 1038 - protein, 15 aa, Artificial Sequence
  Description of Artificial Sequence: Synthetic humanized antibody 141A-huVK3 VL FR2
WYQQKPGQSPRLLIY

SEQ ID NO: 1039 - protein, 15 aa, Artificial Sequence
  Description of Artificial Sequence: Synthetic humanized antibody 141A-huVK3 VL FR2
WYQQKPGQAPRPLIY

SEQ ID NO: 1040 - protein, 15 aa, Artificial Sequence
  Description of Artificial Sequence: Synthetic humanized antibody 141A-huVK3 VL FR2
WYQQKPGQAPRLWIY

SEQ ID NO: 1041 - protein, 15 aa, Artificial Sequence
  Description of Artificial Sequence: Synthetic humanized antibody 141A-huVK3 VL FR2
WYQQKPGQSPRPLIY

SEQ ID NO: 1042 - protein, 15 aa, Artificial Sequence
  Description of Artificial Sequence: Synthetic humanized antibody 141A-huVK3 VL FR2
WYQQKPGQSPRLWIY

SEQ ID NO: 1043 - protein, 15 aa, Artificial Sequence
  Description of Artificial Sequence: Synthetic humanized antibody 141A-huVK3 VL FR2
WYQQKPGQAPRPWIY

SEQ ID NO: 1044 - protein, 15 aa, Artificial Sequence
  Description of Artificial Sequence: Synthetic humanized antibody 141A-huVK3 VL FR2
WYQQKPGQSPRPWIY

SEQ ID NO: 1045 - protein, 7 aa, Artificial Sequence
  Description of Artificial Sequence: Synthetic humanized antibody 141A-huVK3 VL CDR2
ATSQLAS

SEQ ID NO: 1046 - protein, 7 aa, Artificial Sequence
  Description of Artificial Sequence: Synthetic humanized antibody 141A-huVK3 VL CDR2
ATSSLAS

SEQ ID NO: 1047 - protein, 7 aa, Artificial Sequence
  Description of Artificial Sequence: Synthetic humanized antibody 141A-huVK3 VL CDR2
ATSDLAS

SEQ ID NO: 1048 - protein, 7 aa, Artificial Sequence
  Description of Artificial Sequence: Synthetic humanized antibody 141A-huVK3 VL CDR2
ATSALAS

SEQ ID NO: 1049 - protein, 32 aa, Artificial Sequence
  Description of Artificial Sequence: Synthetic humanized antibody 141A-huVK3 VL FR3
GVPDRFSGSGSGTDFTLTISRLEPEDFAVYYC

SEQ ID NO: 1050 - protein, 32 aa, Artificial Sequence
  Description of Artificial Sequence: Synthetic humanized antibody 141A-huVK3 VL FR3
GIPDRFSGSGSGTDYTLTISRLEPEDFAVYYC

SEQ ID NO: 1051 - protein, 32 aa, Artificial Sequence
  Description of Artificial Sequence: Synthetic humanized antibody 141A-huVK3 VL FR3
GIPDRFSGSGSGTDFTLTISRVEPEDFAVYYC

SEQ ID NO: 1052 - protein, 32 aa, Artificial Sequence
  Description of Artificial Sequence: Synthetic humanized antibody 141A-huVK3 VL FR3
GVPDRFSGSGSGTDYTLTISRLEPEDFAVYYC

SEQ ID NO: 1053 - protein, 32 aa, Artificial Sequence
  Description of Artificial Sequence: Synthetic humanized antibody 141A-huVK3 VL FR3
GVPDRFSGSGSGTDFTLTISRVEPEDFAVYYC

SEQ ID NO: 1054 - protein, 32 aa, Artificial Sequence
  Description of Artificial Sequence: Synthetic humanized antibody 141A-huVK3 VL FR3
GIPDRFSGSGSGTDYTLTISRVEPEDFAVYYC

SEQ ID NO: 1055 - protein, 32 aa, Artificial Sequence
  Description of Artificial Sequence: Synthetic humanized antibody 141A-huVK3 VL FR3
GVPDRFSGSGSGTDYTLTISRVEPEDFAVYYC

SEQ ID NO: 1056 - protein, 9 aa, Artificial Sequence
  Description of Artificial Sequence: Synthetic humanized antibody 141A-huVK3 VL CDR3
QQWSSQPYT

SEQ ID NO: 1057 - protein, 9 aa, Artificial Sequence
  Description of Artificial Sequence: Synthetic humanized antibody 141A-huVK3 VL CDR3
QQWSSSPYT

SEQ ID NO: 1058 - protein, 9 aa, Artificial Sequence
  Description of Artificial Sequence: Synthetic humanized antibody
QQWSSAPYT

SEQ ID NO: 1059 - protein, 23 aa, Artificial Sequence
  Description of Artificial Sequence: Synthetic humanized antibody 141A-huVK1 VL FR1
DIQLTQSPSSLSASVGDRVTITC

SEQ ID NO: 1060 - protein, 23 aa, Artificial Sequence
  Description of Artificial Sequence: Synthetic humanized antibody 141A-huVK1 VL FR1
DIQMTQSPSSLSASVGDRVTMTC

SEQ ID NO: 1061 - protein, 23 aa, Artificial Sequence
  Description of Artificial Sequence: Synthetic humanized antibody 141A-huVK1 VL FR1
DIQLTQSPSSLSASVGDRVTMTC

SEQ ID NO: 1062 - protein, 15 aa, Artificial Sequence
  Description of Artificial Sequence: Synthetic humanized antibody 141A-huVK1 VL FR2
WYQQKPGKAPKPLIY

SEQ ID NO: 1063 - protein, 15 aa, Artificial Sequence
  Description of Artificial Sequence: Synthetic humanized antibody 141A-huVK1 VL FR2
WYQQKPGKAPKLWIY

SEQ ID NO: 1064 - protein, 15 aa, Artificial Sequence
  Description of Artificial Sequence: Synthetic humanized antibody 141A-huVK1 VL FR2
WYQQKPGKSPKPLIY

SEQ ID NO: 1065 - protein, 15 aa, Artificial Sequence
  Description of Artificial Sequence: Synthetic humanized antibody 141A-huVK1 VL FR2
WYQQKPGKSPKLWIY

SEQ ID NO: 1066 - protein, 15 aa, Artificial Sequence
  Description of Artificial Sequence: Synthetic humanized antibody 141A-huVK1 VL FR2
WYQQKPGKAPKPWIY

SEQ ID NO: 1067 - protein, 15 aa, Artificial Sequence
  Description of Artificial Sequence: Synthetic humanized antibody 141A-huVK1 VL FR2
WYQQKPGKSPKPWIY

SEQ ID NO: 1068 - protein, 32 aa, Artificial Sequence
  Description of Artificial Sequence: Synthetic humanized antibody 141A-huVK1 VL FR3
GVPSRFSGSGSGTDYTLTISSLQPEDFATYYC

SEQ ID NO: 1069 - protein, 32 aa, Artificial Sequence
  Description of Artificial Sequence: Synthetic humanized antibody 141A-huVK1 VL FR3
GVPSRFSGSGSGTDYTLTISSVQPEDFATYYC

SEQ ID NO: 1070 - protein, 17 aa, Artificial Sequence
  Description of Artificial Sequence: Synthetic humanized antibody 141A-huVH3b VH CDR2
EILPGSGSTNYADSVKG

SEQ ID NO: 1071 - protein, 17 aa, Artificial Sequence
  Description of Artificial Sequence: Synthetic humanized antibody 141A-huVH3b VH CDR2
EILPGSGSTQYADSVKG

SEQ ID NO: 1072 - protein, 17 aa, Artificial Sequence
  Description of Artificial Sequence: Synthetic humanized antibody 141A-huVH3b VH CDR2
EILPGSGSTDYADSVKG

SEQ ID NO: 1073 - protein, 17 aa, Artificial Sequence
  Description of Artificial Sequence: Synthetic humanized antibody 141A-huVH3b VH CDR2
EILPGSGSTAYADSVKG

SEQ ID NO: 1074 - protein, 17 aa, Artificial Sequence
  Description of Artificial Sequence: Synthetic humanized antibody 141A-huVH3b VH CDR2
EILPGSGSTNYADSFKG

SEQ ID NO: 1075 - protein, 17 aa, Artificial Sequence
  Description of Artificial Sequence: Synthetic humanized antibody 141A-huVH3b VH CDR2
EILPGSGSTQYADSFKG

SEQ ID NO: 1076 - protein, 17 aa, Artificial Sequence
  Description of Artificial Sequence: Synthetic humanized antibody 141A-huVH3b VH CDR2
EILPGSGSTSYADSFKG

SEQ ID NO: 1077 - protein, 17 aa, Artificial Sequence
  Description of Artificial Sequence: Synthetic humanized antibody 141A-huVH3b VH CDR2
EILPGSGSTDYADSFKG

SEQ ID NO: 1078 - protein, 17 aa, Artificial Sequence
  Description of Artificial Sequence: Synthetic humanized antibody 141A-huVH3b VH CDR2
EILPGSGSTAYADSFKG

SEQ ID NO: 1079 - protein, 311 aa, Homo sapiens
  C10orf54 polypeptide
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 1080 - DNA, 936 bp, Homo sapiens
  cDNA nucleic acid sequence encoding the C10orf54 polypeptide
atgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatctag

SEQ ID NO: 1081 - protein, 8 aa, Artificial Sequence
  Description of Artificial Sequence: Synthetic humanized antibody 175A VH CDR1 determined by IMGT
GYTFSTHW

SEQ ID NO: 1082 - protein, 8 aa, Artificial Sequence
  Description of Artificial Sequence: Synthetic humanized antibody 175A VH CDR2 determined by IMGT
ILPGSGST

SEQ ID NO: 1083 - protein, 12 aa, Artificial Sequence
  Description of Artificial Sequence: Synthetic humanized antibody 175A VH CDR3 determined by IMGT
ARWLLYYYAMDY

SEQ ID NO: 1084 - protein, 11 aa, Artificial Sequence
  Description of Artificial Sequence: Synthetic humanized antibody 175A VL CDR1 determined by IMGT
QSIVHSNGNTY

SEQ ID NO: 1085 - protein, 3 aa, Artificial Sequence
  Description of Artificial Sequence: Synthetic humanized antibody 175A VL CDR2 determined by IMGT
KLS

SEQ ID NO: 1086 - protein, 5 aa, Artificial Sequence
  Description of Artificial Sequence: Synthetic humanized antibody 175A VH CDR1 determined by Kabat
THWIE

SEQ ID NO: 1087 - protein, 7 aa, Artificial Sequence
  Description of Artificial Sequence: Synthetic humanized antibody 175A VH CDR1 determined by chothia
GYTFSTH

SEQ ID NO: 1088 - protein, 4 aa, Artificial Sequence
  Description of Artificial Sequence: Synthetic humanized antibody 175A VH CDR2 determined by chothia
PGSG

SEQ ID NO: 1089 - protein, 8 aa, Artificial Sequence
  Description of Artificial Sequence: Synthetic humanized antibody 175A VH CDR3 determined by chothia
LLYYYAMD

SEQ ID NO: 1090 - protein, 12 aa, Artificial Sequence
  Description of Artificial Sequence: Synthetic humanized antibody 175A VL CDR1 determined by chothia
SQSIVHSNGNTY

SEQ ID NO: 1091 - protein, 6 aa, Artificial Sequence
  Description of Artificial Sequence: Synthetic humanized antibody 175A VL CDR3 determined by chothia
GSHFPY

SEQ ID NO: 1092 - protein, 6 aa, Artificial Sequence
  Description of Artificial Sequence: Synthetic humanized antibody 175A VH CDR1 determined by Contact
STHWIE

SEQ ID NO: 1093 - protein, 13 aa, Artificial Sequence
  Description of Artificial Sequence: Synthetic humanized antibody 175A VH CDR2 determined by Contact
WIGEILPGSGSTS

SEQ ID NO: 1094 - protein, 11 aa, Artificial Sequence
  Description of Artificial Sequence: Synthetic humanized antibody 175A VH CDR3 determined by Contact
ARWLLYYYAMD

SEQ ID NO: 1095 - protein, 12 aa, Artificial Sequence
  Description of Artificial Sequence: Synthetic humanized antibody 175A VL CDR1 determined by Contact
VHSNGNTYLEWY

SEQ ID NO: 1096 - protein, 10 aa, Artificial Sequence
  Description of Artificial Sequence: Synthetic humanized antibody 175A VL CDR2 determined by Contact
LLIYKLSNRF

SEQ ID NO: 1097 - protein, 8 aa, Artificial Sequence
  Description of Artificial Sequence: Synthetic humanized antibody 175A VL CDR3 determined by Contact
FQGSHFPY

SEQ ID NO: 1098 - protein, 10 aa, Artificial Sequence
  Description of Artificial Sequence: Synthetic humanized antibody 175A VH CDR2 determined by AbM
EILPGSGSTS

SEQ ID NO: 1099 - protein, 8 aa, Artificial Sequence
  Description of Artificial Sequence: Synthetic humanized antibody 76E1 VH CDR1 determined by IMGT
GYSFTGYN

SEQ ID NO: 1100 - protein, 8 aa, Artificial Sequence
  Description of Artificial Sequence: Synthetic humanized antibody 76E1 VH CDR2 determined by IMGT
IDPYYDYT

SEQ ID NO: 1101 - protein, 11 aa, Artificial Sequence
  Description of Artificial Sequence: Synthetic humanized antibody 76E1 VH CDR3 determined by IMGT
ATSTMITPFDY

SEQ ID NO: 1102 - protein, 11 aa, Artificial Sequence
  Description of Artificial Sequence: Synthetic humanized antibody 76E1 VL CDR1 determined by IMGT
QSIVHSNGNTY

SEQ ID NO: 1103 - protein, 3 aa, Artificial Sequence
  Description of Artificial Sequence: Synthetic humanized antibody 76E1 VL CDR2 determined by IMGT
KVS

SEQ ID NO: 1104 - protein, 5 aa, Artificial Sequence
  Description of Artificial Sequence: Synthetic humanized antibody 76E1 VH CDR1 determined by Kabat
GYNMN

SEQ ID NO: 1105 - protein, 7 aa, Artificial Sequence
  Description of Artificial Sequence: Synthetic humanized antibody 76E1 VH CDR1 determined by Chothia
GYSFTGY

SEQ ID NO: 1106 - protein, 4 aa, Artificial Sequence
  Description of Artificial Sequence: Synthetic humanized antibody 76E1 VH CDR2 determined by Chothia
PYYD

SEQ ID NO: 1107 - protein, 7 aa, Artificial Sequence
  Description of Artificial Sequence: Synthetic humanized antibody 76E1 VH CDR3 determined by Chothia
TMITPFD

SEQ ID NO: 1108 - protein, 12 aa, Artificial Sequence
  Description of Artificial Sequence: Synthetic humanized antibody 76E1 VL CDR1 determined by Chothia
SQSIVHSNGNTY

SEQ ID NO: 1109 - protein, 6 aa, Artificial Sequence
  Description of Artificial Sequence: Synthetic humanized antibody 76E1 VL CDR3 determined by Chothia
GSHVPW

SEQ ID NO: 1110 - protein, 6 aa, Artificial Sequence
  Description of Artificial Sequence: Synthetic humanized antibody 76E1 VH CDR1 determined by Contact
TGYNMN

SEQ ID NO: 1111 - protein, 13 aa, Artificial Sequence
  Description of Artificial Sequence: Synthetic humanized antibody 76E1 VH CDR2 determined by Contact
WIGNIDPYYDYTS

SEQ ID NO: 1112 - protein, 10 aa, Artificial Sequence
  Description of Artificial Sequence: Synthetic humanized antibody 76E1 VH CDR3 determined by Contact
ATSTMITPFD

SEQ ID NO: 1113 - protein, 12 aa, Artificial Sequence
  Description of Artificial Sequence: Synthetic humanized antibody 76E1 VL CDR1 determined by Contact
VHSNGNTYLEWY

SEQ ID NO: 1114 - protein, 10 aa, Artificial Sequence
  Description of Artificial Sequence: Synthetic humanized antibody 76E1 VL CDR2 determined by Contact
LLIYKVSNRF

SEQ ID NO: 1115 - protein, 8 aa, Artificial Sequence
  Description of Artificial Sequence: Synthetic humanized antibody 76E1 VL CDR3 determined by Contact
FQGSHVPW

SEQ ID NO: 1116 - protein, 10 aa, Artificial Sequence
  Description of Artificial Sequence: Synthetic humanized antibody 76E1 VH CDR2 determined by AbM
NIDPYYDYTS

SEQ ID NO: 1117 - protein, 8 aa, Artificial Sequence
  Description of Artificial Sequence: Synthetic humanized antibody 141A VH CDR1 determined by IMGT
GYTFSRYW

SEQ ID NO: 1118 - protein, 8 aa, Artificial Sequence
  Description of Artificial Sequence: Synthetic humanized antibody 141A VH CDR2 determined by IMGT
ILPGSGST

SEQ ID NO: 1119 - protein, 14 aa, Artificial Sequence
  Description of Artificial Sequence: Synthetic humanized antibody 141A VH CDR3 determined by IMGT
AGEEVYDGYPWFGY

SEQ ID NO: 1120 - protein, 5 aa, Artificial Sequence
  Description of Artificial Sequence: Synthetic humanized antibody 141A VL CDR1 determined by IMGT
SSLSY

SEQ ID NO: 1121 - protein, 3 aa, Artificial Sequence
  Description of Artificial Sequence: Synthetic humanized antibody 141A VL CDR2 determined by IMGT
ATS

SEQ ID NO: 1122 - protein, 5 aa, Artificial Sequence
  Description of Artificial Sequence: Synthetic humanized antibody 141A VH CDR1 determined by Kabat
RYWIE

SEQ ID NO: 1123 - protein, 7 aa, Artificial Sequence
  Description of Artificial Sequence: Synthetic humanized antibody 141A VH CDR1 determined by Chothia
GYTFSRY

SEQ ID NO: 1124 - protein, 4 aa, Artificial Sequence
  Description of Artificial Sequence: Synthetic humanized antibody 141A VH CDR2 determined by Chothia
PGSG

SEQ ID NO: 1125 - protein, 10 aa, Artificial Sequence
  Description of Artificial Sequence: Synthetic humanized antibody 141A VH CDR3 determined by Chothia
EVYDGYPWFG

SEQ ID NO: 1126 - protein, 6 aa, Artificial Sequence
  Description of Artificial Sequence: Synthetic humanized antibody 141A VL CDR1 determined by Chothia
SSSLSY

SEQ ID NO: 1127 - protein, 6 aa, Artificial Sequence
  Description of Artificial Sequence: Synthetic humanized antibody 141A VL CDR3 determined by Chothia
WSSNPY

SEQ ID NO: 1128 - protein, 6 aa, Artificial Sequence
  Description of Artificial Sequence: Synthetic humanized antibody 141A VH CDR1 determined by Contact
SRYWIE

SEQ ID NO: 1129 - protein, 13 aa, Artificial Sequence
  Description of Artificial Sequence: Synthetic humanized antibody 141A VH CDR2 determined by Contact
WIGEILPGSGSTN

SEQ ID NO: 1130 - protein, 13 aa, Artificial Sequence
  Description of Artificial Sequence: Synthetic humanized antibody 141A VH CDR3 determined by Contact
AGEEVYDGYPWFG

SEQ ID NO: 1131 - protein, 6 aa, Artificial Sequence
  Description of Artificial Sequence: Synthetic humanized antibody 141A VL CDR1 determined by Contact
SYMHWY

SEQ ID NO: 1132 - protein, 10 aa, Artificial Sequence
  Description of Artificial Sequence: Synthetic humanized antibody 141A VL CDR2 determined by Contact
PWIYATSNLA

SEQ ID NO: 1133 - protein, 8 aa, Artificial Sequence
  Description of Artificial Sequence: Synthetic humanized antibody 141A VL CDR3 determined by Contact
QQWSSNPY

SEQ ID NO: 1134 - protein, 10 aa, Artificial Sequence
  Description of Artificial Sequence: Synthetic humanized antibody 141A VH CDR2 determined by Contact
EILPGSGSTN

SEQ ID NO: 1135 - protein, 118 aa, Artificial Sequence
  Description of Artificial Sequence: Synthetic VH of humanized antibody hu76E1
QVQLVQSGAEVKKPGASVKVSCKASGYSFTGYNMNWVRQAPGQGLEWIGNIDPYYDYTSYNLKFKDRVTMTVDKSTSTAYMELRSLRSDDTAVYYCATSTMITPFDYWGQGTLVTVSS

SEQ ID NO: 1136 - protein, 121 aa, Artificial Sequence
  Description of Artificial Sequence: Synthetic VH of humanized antibody hu141A
QVQLVQSGAEVKKPGASVKVSCKASGYTFSRYWIEWVRQAPGQGLEWIGEILPGSGSTNYNEKFKGRVTMTADTSTSTAYMELRSLRSDDTAVYYCAGEEVYDGYPWFGYWGQGTLVTVSS

SEQ ID NO: 1137 - protein, 119 aa, Artificial Sequence
  Description of Artificial Sequence: Synthetic VH of humanized antibody hu175A
QVQLVQSGAEVKKPGASVKVSCKASGYTFSTHWIEWVRQAPGQGLEWIGEILPGSGSTSYNEKFKGRVTMTADTSTSTAYMELRSLRSDDTAVYYCARWLLYYYAMDYWGQGTLVTVSS

SEQ ID NO: 1138 - protein, 121 aa, Artificial Sequence
  Description of Artificial Sequence: Synthetic consensus sequences of VH of humanized antibodies between hu76E1 and hu175A
  MOD_RES (31)..(31): Arg or Thr
  MOD_RES (32)..(32): Tyr or His
  MOD_RES (59)..(59): Asn or Ser
  MOD_RES (99)..(107): Any amino acid
  MOD_RES (108)..(108): Met or Phe
  MOD_RES (109)..(109): Gly or Asp
QVQLVQSGAEVKKPGASVKVSCKASGYTFSXXWIEWVRQAPGQGLEWIGEILPGSGSTXYNEKFKGRVTMTADTSTSTAYMELRSLRSDDTAVYYCARXXXXXXXXXXXYWGQGTLVTVSS

SEQ ID NO: 1139 - protein, 106 aa, Artificial Sequence
  Description of Artificial Sequence: Synthetic VL of humanized antibody hu76E1
EIVLTQSPGTLSLSPGERATLSCRASSSLSYMHWYQQKPGQAPRPWIYATSNLASGIPDRFSGSGSGTDYTLTISRLEPEDFAVYYCQQWSSNPYTFGQGTKLEIK

SEQ ID NO: 1140 - protein, 112 aa, Artificial Sequence; identical to SEQ ID NO: 24
  Description of Artificial Sequence: Synthetic VL of humanized antibody hu141A

SEQ ID NO: 1141 - protein, 112 aa, Artificial Sequence; identical to SEQ ID NO: 28
  Description of Artificial Sequence: Synthetic VL of humanized antibody hu175A

SEQ ID NO: 1142 - protein, 112 aa, Artificial Sequence
  Description of Artificial Sequence: Synthetic consensus sequences of VL of humanized antibodies between hu76E1 and hu175A
  MOD_RES (56)..(56): Val or Leu
  MOD_RES (99)..(99): Val or Phe
  MOD_RES (101)..(101): Trp or Tyr
DIVMTQSPLSLPVTPGEPASISCRSSQSIVHSNGNTYLEWYLQKPGQSPQLLIYKXSNRFSGVPDRFSGSGSGTDFTLKISRVEAEDVGVYYCFQGSHXPXTFGQGTKLEIK

SEQ ID NO: 1143 - protein, 118 aa, Artificial Sequence
  Description of Artificial Sequence: Synthetic pseudo-sequences of VH domains of murine antibodies 76E1
EVQLLQSGPELEKPGASVKISCKASGYSFAAAAAAWVKQSNGKSLEWIGAIAAAAAAAAAAAAAAAKATLTVDKSSSTAYMQLKSLTSEDSAVYYCATAAAAAAFDYWGQGTTLTVSS

SEQ ID NO: 1144 - protein, 121 aa, Artificial Sequence
  Description of Artificial Sequence: Synthetic pseudo-sequences of VH domains of murine antibodies 141A
QVQLQQSGAELMKPGASVKISCKATGYTFAAAAAAWVKQRPGHGLEWIGAIAAAAAAAAAAAAAAAKATFTADTSSNTAYMQLSSLTSEDSAVYYCAGAAAAAAAAAAAAWGQGTLVTVSA

SEQ ID NO: 1145 - protein, 119 aa, Artificial Sequence
  Description of Artificial Sequence: Synthetic pseudo-sequences of VH domains of murine antibodies 175A
QVQLQQSGAELMKPGASVKISCKATGYTFAAAAAAWVKQRPGHGLEWIGAIAAAAAAAAAAAAAAAKATFTADTSSNTAYMQLSSLTSEDSAVYYCARAAAAAYAMDYWGQGTSVTVSS

SEQ ID NO: 1146 - protein, 112 aa, Artificial Sequence
  Description of Artificial Sequence: Synthetic pseudo-sequences of VL domains of murine antibodies 76E1
DVLMTQTPLSLPVSLGDQASISCRSSQSAAAAAAAAAAAWYLQKPGQSPKLLIYAAAAAAAGVPDRFSGSGSGTDFTLKINRVEAEDLGVYYCAQAAAAPATFGGGTKLEIK

SEQ ID NO: 1147 - protein, 106 aa, Artificial Sequence
  Description of Artificial Sequence: Synthetic pseudo-sequences of VL domains of murine antibodies 141A
QIVLSQSPAILSASPGEKVTMTCRASAAAAAAAWYQQKPGSSPKPWIYAAANLASGVPARFSGSGSGTSYSLTISRVEAEDAATYYCQQAAAAPATFGGGTKLEIK

SEQ ID NO: 1148 - protein, 112 aa, Artificial Sequence
  Description of Artificial Sequence: Synthetic pseudo-sequences of VL domains of murine antibodies 175A
DVLMTQTPLSLPVSLGDQASISCRSSQSAAAAAAAAAAAWYLQKPGQSPKLLIYAAAAAAAGVPDRFSGSGSGTDFTLKISRVEAEDLGVYYCAQAAAAPATFGGGTKLEIK

SEQ ID NO: 1149 - protein, 10 aa, Artificial Sequence
  Description of Artificial Sequence: Synthetic VH CDR1 of a humanized anti-C10orf54 antibody
  MOD_RES (6)..(6): Arg or Thr
  MOD_RES (7)..(7): Tyr or His
GYTFSXXWIE

SEQ ID NO: 1150 - protein, 17 aa, Artificial Sequence
  Description of Artificial Sequence: Synthetic VH CDR2 of a humanized anti-C10orf54 antibody
  MOD_RES (10)..(10): Asn or Ser
EILPGSGSTXYNEKFKG

SEQ ID NO: 1151 - protein, 12 aa, Artificial Sequence
  Description of Artificial Sequence: Synthetic VH CDR3 of a humanized anti-C10orf54 antibody
  MOD_RES (1)..(9): Any amino acid
  MOD_RES (10)..(10): Met or Phe
  MOD_RES (11)..(11): Gly or Asp
XXXXXXXXXXXY

SEQ ID NO: 1152 - protein, 7 aa, Artificial Sequence
  Description of Artificial Sequence: Synthetic VL CDR2 of a humanized anti-C10orf54 antibody
  MOD_RES (2)..(2): Val or Leu
KXSNRFS

SEQ ID NO: 1153 - protein, 9 aa, Artificial Sequence
  Description of Artificial Sequence: Synthetic VL CDR3 of a humanized anti-C10orf54 antibody
  MOD_RES (6)..(6): Val or Phe
  MOD_RES (8)..(8): Trp or Tyr
FQGSHXPXT

SEQ ID NO: 1154 - DNA, 408 bp, Artificial Sequence
  Description of Artificial Sequence: Synthetic 5B heavy chain variable region with signal sequence
atgggttggagctgtatcatcttctttctggtagcaacagctacaggtgtgcactcccaggtccagctgcagcagtctggggctgagctggtgaggcctggggtctcagtgaagatttcctgcaagggttctggctacacattcactgattatggtatgcactgggtgaagcagagtcatgcaaagagtctagagtggattggaattattgatacttactatggtgatgctacctacaaccagaagttcaagggcaaggccacgatgactgtagacaaatcctccagcacagcctatatggaacttgccagactgacatctgaggattctgccatctattactgtgcaagaagggctgggaatgctatggactactggggtcaaggaacctcagtcaccgtctcctca

SEQ ID NO: 1155 - protein, 136 aa, Artificial Sequence
  Description of Artificial Sequence: Synthetic 5B heavy chain variable region with signal sequence
MGWSCIIFFLVATATGVHSQVQLQQSGAELVRPGVSVKISCKGSGYTFTDYGMHWVKQSHAKSLEWIGIIDTYYGDATYNQKFKGKATMTVDKSSSTAYMELARLTSEDSAIYYCARRAGNAMDYWGQGTSVTVSS

SEQ ID NO: 1156 - DNA, 381 bp, Artificial Sequence
  Description of Artificial Sequence: Synthetic 5B light chain variable region with signal sequence
atgaagtcacagacccaggtcttcgtatttctactgctctgtgtgtctggtgctcatgggaatattgtgatgacccagactcccaaattcctgcttgtatcagcaggagacagggttaccataacctgcaaggccagtcagagtgtgagtaatgatgtagcttggtaccaacagaagccagggcagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatagctctcctcggacgttcggtggaggcaccaagctggaaatcaaa

SEQ ID NO: 1157 - protein, 127 aa, Artificial Sequence
  Description of Artificial Sequence: Synthetic 5B light chain variable region with signal sequence
MKSQTQVFVFLLLCVSGAHGNIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPRTFGGGTKLEIK

SEQ ID NO: 1158 - DNA, 408 bp, Artificial Sequence
  Description of Artificial Sequence: Synthetic 46A heavy chain variable region with signal sequence
atgggttggagctgtatcgtcttctttctggtagcaacagctacaggtgtgcactcccaggtccagctgcagcaggccgggggtgagctggtgaggcctggggtctcagtgaagatttcctgcaagggttctggctacacattcactgattatggtatgcactgggtgaagcagagtcatgcaaagagtctagagtggattggaattattaatacttactatggggatgctacctacaaccagaagttcaagggcaaggccacaatgactgtagacaaatcctccagcacagcctatatggaacttgccagactgacatctgaggattctgccatctattactgtgcaagaagggctgggactgctatggactactggggtcaaggaacctcagtcaccgtctcctca

SEQ ID NO: 1159 - protein, 136 aa, Artificial Sequence
  Description of Artificial Sequence: Synthetic 46A heavy chain variable region with signal sequence
MGWSCIVFFLVATATGVHSQVQLQQAGGELVRPGVSVKISCKGSGYTFTDYGMHWVKQSHAKSLEWIGIINTYYGDATYNQKFKGKATMTVDKSSSTAYMELARLTSEDSAIYYCARRAGTAMDYWGQGTSVTVSS

SEQ ID NO: 1160 - DNA, 381 bp, Artificial Sequence
  Description of Artificial Sequence: Synthetic 46A light chain variable region with signal sequence
atgaagtcacagacccaggtcttcgtatttctactgctctgtgtgtctggtggtcatgggagtattgtgatgacccagactcccaaattcctgcttgtatcagcaggagacagggttaccataacctgcaaggccagtcagagtgtgagtaatgatgtagcttggtaccaacagaagccagggcagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatggctctcctcggacgttcggtggaggcaccaagctggaaatcaaa

SEQ ID NO: 1161 - protein, 127 aa, Artificial Sequence
  Description of Artificial Sequence: Synthetic 46A light chain variable region with signal sequence
MKSQTQVFVFLLLCVSGGHGSIVMTQTPKFLLVSAGDRVTITCKASQSVSNDVAWYQQKPGQSPKLLIYYASNRYTGVPDRFTGSGYGTDFTFTISTVQAEDLAVYFCQQDYGSPRTFGGGTKLEIK

SEQ ID NO: 1162 - DNA, 408 bp, Artificial Sequence
  Description of Artificial Sequence: Synthetic 97A heavy chain variable region with signal sequence
atgggttggagctgtatcatcttctttctggtagcaacagctacaggtgtgcactcccaggtccagctgcagcagtctggggctgagctggtgaggcctggggtctcagtgaagatttcctgcaagggttctggctacacattcactgattatggtatgcactgggtgaagcagagtcatgcaaagagtctagagtggattggagttattgatacttactatggtgatgctagtaacaaccagaagttcaagggcaaggccacaatgactgtagacaaatcctccagcacagcctatatggaacttgccagactgacatctgaggattctgccatctattactgtgcaagaagggctgggaatgctatggactactggggtcaaggaacctcagtcaccgtctcctca

SEQ ID NO: 1163 - protein, 136 aa, Artificial Sequence
  Description of Artificial Sequence: Synthetic 97A heavy chain variable region with signal sequence
MGWSCIIFFLVATATGVHSQVQLQQSGAELVRPGVSVKISCKGSGYTFTDYGMHWVKQSHAKSLEWIGVIDTYYGDASNNQKFKGKATMTVDKSSSTAYMELARLTSEDSAIYYCARRAGNAMDYWGQGTSVTVSS

SEQ ID NO: 1164 - DNA, 381 bp, Artificial Sequence
  Description of Artificial Sequence: Synthetic 97A light chain variable region with signal sequence
atgaagtcacagacccaggtcttcgtatttctactgctctgtgtgtctggtgctcatgggagtattgtgatgacccagactcccaaattcctgcttgtatcagcaggagacagggttgccataacctgcaaggccagtcagagtgtgagtaatgatgtagcttggtaccaacagaagccagggcagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatggctctcctcggacgttcggtggaggcaccaagctggaaatcaaa

SEQ ID NO: 1165 - protein, 127 aa, Artificial Sequence
  Description of Artificial Sequence: Synthetic 97A light chain variable region with signal sequence
MKSQTQVFVFLLLCVSGAHGSIVMTQTPKFLLVSAGDRVAITCKASQSVSNDVAWYQQKPGQSPKLLIYYASNRYTGVPDRFTGSGYGTDFTFTISTVQAEDLAVYFCQQDYGSPRTFGGGTKLEIK

SEQ ID NO: 1166 - DNA, 408 bp, Artificial Sequence
  Description of Artificial Sequence: Synthetic 128A heavy chain variable region with signal sequence
atgggttggagctgtatcatcttctttctggtagcaacagctacaggtgtgcactcccaggtccagctgcagcagtctggggctgagctggtgaggcctggggtctcagtgaagatttcctgcaagggttctggctacacattcactgattatggtatgcactgggtgaagcagagtcatgcaaagagtctagagtggattggacttattgatacttactatggtgatgctacctacaaccacaaattcaagggcaaggccacgatgactgtagacaaatcctccagaacagcctatatggaacttgccagactgacatctgaggattctgccatctattactgtgcaagaagggctgggaatgctatggactactggggtcaaggaacctcagtcaccgcctcctca

SEQ ID NO: 1167 - protein, 136 aa, Artificial Sequence
  Description of Artificial Sequence: Synthetic 128A heavy chain variable region with signal sequence
MGWSCIIFFLVATATGVHSQVQLQQSGAELVRPGVSVKISCKGSGYTFTDYGMHWVKQSHAKSLEWIGLIDTYYGDATYNHKFKGKATMTVDKSSRTAYMELARLTSEDSAIYYCARRAGNAMDYWGQGTSVTASS

SEQ ID NO: 1168 - DNA, 381 bp, Artificial Sequence
  Description of Artificial Sequence: Synthetic 128A light chain variable region with signal sequence
atgaagtcacagacccaggtcttcgtatttctactgctctgtgtgtctggtactcatgggaatattgcgatgacccagactcccaaattcctgcttgtatcagcaggagacagggttaccataacctgcaaggccagtcagagtgtgagtaatgatatagcttggtaccaacagaagccaggacagtctcctagattgctgatatactatgcatccaatcgctacactggagtccctgatcgcttcactggcagtggatatgggacggatttcactttcaccatcagcactgtgcaggctgaagacctggcagtttatttctgtcagcaggattatagctctcctcggacgttcggtggaggcaccaagctggaaatcaaa

SEQ ID NO: 1169 - protein, 127 aa, Artificial Sequence
  Description of Artificial Sequence: Synthetic 128A light chain variable region with signal sequence
MKSQTQVFVFLLLCVSGTHGNIAMTQTPKFLLVSAGDRVTITCKASQSVSNDIAWYQQKPGQSPRLLIYYASNRYTGVPDRFTGSGYGTDFTFTISTVQAEDLAVYFCQQDYSSPRTFGGGTKLEIK

SEQ ID NO: 1170 - DNA, 408 bp, Artificial Sequence; identical to SEQ ID NO: 1166
  Description of Artificial Sequence: Synthetic 146C heavy chain variable region with signal sequence

SEQ ID NO: 1171 - protein, 136 aa, Artificial Sequence; identical to SEQ ID NO: 1167
  Description of Artificial Sequence: Synthetic 146C heavy chain variable region with signal sequence

SEQ ID NO: 1172 - DNA, 381 bp, Artificial Sequence; identical to SEQ ID NO: 1168
  Description of Artificial Sequence: Synthetic 146C light chain variable region with signal sequence

SEQ ID NO: 1173 - protein, 127 aa, Artificial Sequence; identical to SEQ ID NO: 1169
  Description of Artificial Sequence: Synthetic 146C light chain variable region with signal sequence

SEQ ID NO: 1174 - DNA, 408 bp, Artificial Sequence
  Description of Artificial Sequence: Synthetic 208A heavy chain variable region with signal sequence
atgggttggagctgtatcatcttctttctggtagcaacagctacaggtgtgcactcccaggtccagctgcagcagtctggggctgagctggtgaggcctggggtctcagtgaagatttcctgcaagggttctggctacacattcactgattatggtatgcactgggtgaagcagagtcatgcaaagagtctagagtggattggagttattgatacttactatggtgatgctggctacaaccagaagttcaagggcaaggccacaatgactgtagacaaatcctccagcacagcctatatggaacttgccagactgacatctgaggattctgccatctattactgtgcaagaagggctggaaatgctatggactactggggtcaaggaacctcagtcaccgtctcctca

SEQ ID NO: 1175 - protein, 136 aa, Artificial Sequence
  Description of Artificial Sequence: Synthetic 208A heavy chain variable region with signal sequence
MGWSCIIFFLVATATGVHSQVQLQQSGAELVRPGVSVKISCKGSGYTFTDYGMHWVKQSHAKSLEWIGVIDTYYGDAGYNQKFKGKATMTVDKSSSTAYMELARLTSEDSAIYYCARRAGNAMDYWGQGTSVTVSS

SEQ ID NO: 1176 - DNA, 381 bp, Artificial Sequence
  Description of Artificial Sequence: Synthetic 208A light chain variable region with signal sequence
atgaagtcacagacccaggtcttcgtatttctactgctctgtgtgtctggtgctcttgggagtattgtgatgacccagactcccaaattcctgcttgtatcagcaggagacagggtcaccataacctgcaaggccagtcagagtgtgagtaatgatgttgcttggtaccaacagaagccagggcagtctcctaaactgctgatatactatgcatccaatcgctacactggagtccctgatcgcttcactggcagtggatatgggacggatttcactttcaccatcagcactgtgcaggctgaggacctggcagtttatttctgtcagcaggattatagctctcctcggacgttcggtggaggcaccaagctggaaatcaaa

SEQ ID NO: 1177 - protein, 127 aa, Artificial Sequence
  Description of Artificial Sequence: Synthetic 208A light chain variable region with signal sequence
MKSQTQVFVFLLLCVSGALGSIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPRTFGGGTKLEIK

SEQ ID NO: 1178 - DNA, 411 bp, Artificial Sequence
  Description of Artificial Sequence: Synthetic 215A heavy chain variable region with signal sequence
atgggatggagctggatctttctcttcctcctgtcaggaactgcaggtgtccactctgaggtccagctgcagcagtctggacctgagttggtgaagcctggtgcttcaatgaagatatcctgcaaggcttctggtttctctttcactggctacaccatgaactgggtgaagcagagccatggaaagaaccttgagtggattggacttattagtccttacaatggtggtactagctacaaccagaagttcaagggcaaggccacattaactgtagataagtcatccagcacagcctacatggagctcctcagtctgacatctgaggactctgcagtctattactgtgcaagaagggcctacggctatgctatggactactggggtcaaggaacctcagtcaccgtctcctca

SEQ ID NO: 1179 - protein, 137 aa, Artificial Sequence
  Description of Artificial Sequence: Synthetic 215A heavy chain variable region with signal sequence
MGWSWIFLFLLSGTAGVHSEVQLQQSGPELVKPGASMKISCKASGFSFTGYTMNWVKQSHGKNLEWIGLISPYNGGTSYNQKFKGKATLTVDKSSSTAYMELLSLTSEDSAVYYCARRAYGYAMDYWGQGTSVTVSS

SEQ ID NO: 1180 - DNA, 384 bp, Artificial Sequence
  Description of Artificial Sequence: Synthetic 215A light chain variable region with signal sequence
atggattttcaagtgcagattttcagcttcctgctaatcagtgcctcagtcatactgtccagaggacaaattgttctcacccagtctccagcaatcatgtctgcatctccaggggagaaggtcaccatgacctgcagtgccagctcaagtgtaagttacatgttctggtaccagcagaagccaggatcctcccccagactcctgatttatgacacatccaacctggcttctggagtccctcttcgcttcagtggcagtgggtctgggacctcttactctctcacaatcagccgaatggaggctgaggatgctgccacttattactgccagcagtggagtagttacccattcacgttcggctcggggacaaagttggaaataaaa

SEQ ID NO: 1181 - protein, 128 aa, Artificial Sequence
  Description of Artificial Sequence: Synthetic 215A light chain variable region with signal sequence
MDFQVQIFSFLLISASVILSRGQIVLTQSPAIMSASPGEKVTMTCSASSSVSYMFWYQQKPGSSPRLLIYDTSNLASGVPLRFSGSGSGTSYSLTISRMEAEDAATYYCQQWSSYPFTFGSGTKLEIK

SEQ ID NO: 1182 - DNA, 411 bp, Artificial Sequence
  Description of Artificial Sequence: Synthetic 26A heavy chain variable region with signal sequence
atgggatggagctggatctttctcttcctcctgtcaggaactgcaggtgtccactctgaggtccagctgcagcagtctggacctgagctggtgaagcctggtgcttcaatgaagatatcctgcaaggcttctggtttctcattcactggctacaccatgaactgggtgaagcagagccatgtaaagaaccttgagtggattggacttattagtccttacaatggtggtactagctacaaccagaagttcaagggcaaggccacattaactgtagacaagtcatccagcacagcctacatggagctcctcagtctgacatctgaggactctgcagtctattactgtgcaagaagggcctacggctatgctatggactactggggtcaaggaacctcagtcaccgtctcctca

SEQ ID NO: 1183 - protein, 137 aa, Artificial Sequence
  Description of Artificial Sequence: Synthetic 26A heavy chain variable region with signal sequence
MGWSWIFLFLLSGTAGVHSEVQLQQSGPELVKPGASMKISCKASGFSFTGYTMNWVKQSHVKNLEWIGLISPYNGGTSYNQKFKGKATLTVDKSSSTAYMELLSLTSEDSAVYYCARRAYGYAMDYWGQGTSVTVSS

SEQ ID NO: 1184 - DNA, 384 bp, Artificial Sequence
  Description of Artificial Sequence: Synthetic 26A light chain variable region with signal sequence
atggattttcaagtgcagattttcagcttcctgctaatcagtgcctcagtcatactgtccagaggacaaattgttctcacccagtctccagcaatcatgtctgcatctccaggggagaaggtcaccatgacctgcagtgccagctcaagtgtaagttacatgtactggtaccagcagaagccaggatcctcccccagactcctgatttatgacacatccaacctggcttctggagtccctcttcgcttcagtggcagtgggtctgggacctcttactctctcacaatcagccgaatggaggctgaggatgctgccacttattactgccagcagtggagtagttacccattcacgttcggctcggggacaaagttggaaataaaa

SEQ ID NO: 1185 - protein, 128 aa, Artificial Sequence
  Description of Artificial Sequence: Synthetic 26A light chain variable region with signal sequence
MDFQVQIFSFLLISASVILSRGQIVLTQSPAIMSASPGEKVTMTCSASSSVSYMYWYQQKPGSSPRLLIYDTSNLASGVPLRFSGSGSGTSYSLTISRMEAEDAATYYCQQWSSYPFTFGSGTKLEIK

SEQ ID NO: 1186 - DNA, 417 bp, Artificial Sequence
  Description of Artificial Sequence: Synthetic 164A heavy chain variable region with signal sequence
atgggatggacctggatctttattttaatcctgtcagtaactacaggtgtccactctgaggtccagctgcagcagtctggacctgagttggagaagcctggcgcttcagtgaagatatcctgcaaggcttctggttactcattcactggctacaacatgaactgggtgaagcagagcaatggaaagagccttgagtggattggaaatattgatccttactatggtagtgctagctacaaccagaaattcaagggcaaggccacattgactgtagacaaatcctccaccacagcctacatgcagctcaagagcctgacatctgaagactctgcagtctattactgtacaagaagtaattatggttactacgggtacttcgatgtctggggcgcagggaccacggtcaccgtctcctca

SEQ ID NO: 1187 - protein, 139 aa, Artificial Sequence
  Description of Artificial Sequence: Synthetic 164A heavy chain variable region with signal sequence
MGWTWIFILILSVTTGVHSEVQLQQSGPELEKPGASVKISCKASGYSFTGYNMNWVKQSNGKSLEWIGNIDPYYGSASYNQKFKGKATLTVDKSSTTAYMQLKSLTSEDSAVYYCTRSNYGYYGYFDVWGAGTTVTVSS

SEQ ID NO: 1188 - DNA, 396 bp, Artificial Sequence
  Description of Artificial Sequence: Synthetic 164A light chain variable region with signal sequence
atggaatcacagactcaggtcttcctctccctgctgctctgggtatctggtacctgtgggaacattatgatgacacagtcgccatcatctctggctgtgtctgcaggagaaaaggtcactatgagctgtaagtccagtcaaagtgttttatacagttcaaatcagaagaactacttggcctggtaccagcagaaaccagggcagtctcctaaactgctgatctattgggcatccactagggaatctggtgtccctgatcgcttcacaggcagtggatctgggacagattttactcttactatcagcagtgtacaagctgaagacctggcagtttattactgtcatcaattcctctcctcgtacacgttcggaggggggaccaagctggaaatgaaa

SEQ ID NO: 1189 - protein, 132 aa, Artificial Sequence
  Description of Artificial Sequence: Synthetic 164A light chain variable region with signal sequence
MESQTQVFLSLLLWVSGTCGNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQFLSSYTFGGGTKLEMK

SEQ ID NO: 1190 - DNA, 390 bp, Artificial Sequence
  Description of Artificial Sequence: Synthetic 164A light chain variable region number 2 with signal sequence
atggattttcaggtgcagattttcagcttcctgttaatcagtgtctcagtcataatgtccagaggagaaaatgtgctgacccagtctccagcaatcatggctgcatctccaggggagaaggtcaccatgacctgcagtgccagctcaagtgtaagttctagtaacttgcactggtaccagcagaagtcaggcacttctaccaaattctggatttataggacatccaacctggcttcagaagtcccagctcccttcagtggcagtgggtctgggacctcttactctcttacaatcagcagcgtggaggccgaagatgctgccacttattactgccagcagtggagtggttacccacggacgttcggtggaggcaccaagctggaaatcaaa

SEQ ID NO: 1191 - protein, 130 aa, Artificial Sequence
  Description of Artificial Sequence: Synthetic 164A light chain variable region number 2 with signal sequence
MDFQVQIFSFLLISVSVIMSRGENVLTQSPAIMAASPGEKVTMTCSASSSVSSSNLHWYQQKSGTSTKFWIYRTSNLASEVPAPFSGSGSGTSYSLTISSVEAEDAATYYCQQWSGYPRTFGGGTKLEIK

SEQ ID NO: 1192 - protein, 139 aa, Artificial Sequence
  Description of Artificial Sequence: Synthetic 230A heavy chain variable region with signal sequence
MGWTWIFILILSVTTGVHSEVQLQQSGPELEKPGASVKISCKASGYSFTGSNMNWVKQNNGKSLEWIGNIDPYYGYTTYNQKFKGKATLTVDKSSSTAYMQLKSLTSEDSAVYYCARDYDYALGYFDVWGAGTTVTVSS

SEQ ID NO: 1193 - DNA, 393 bp, Artificial Sequence
  Description of Artificial Sequence: Synthetic 230A light chain variable region with signal sequence
atgaagttgcctgttaggctgttggtgctgatgttctggattcctgcttccagcagtgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgtacacgttcggaggggggaccaagctggaaataaaa

SEQ ID NO: 1194 - protein, 131 aa, Artificial Sequence
  Description of Artificial Sequence: Synthetic 230A light chain variable region with signal sequence
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 1195 - DNA, 411 bp, Artificial Sequence
  Description of Artificial Sequence: Synthetic 76E1 heavy chain variable region with signal sequence
atgggatggacctggatctttattttaatcctgtcagtaactacaggtgtccactctgaggtccagctgctgcagtctggacctgagctggagaagcctggcgcttcagtgaagatatcctgcaaggcttctggttactcattcactggctacaacatgaactgggtgaagcagagcaatggaaagagccttgagtggattggaaatattgatccttactatgattatactagttacaacctgaagttcaaggacaaggccacattgactgtagacaaatcctccagcacagcctacatgcagctcaagagcctgacatctgaggactctgcagtctattactgtgcaacctctactatgattactccctttgactactggggccaaggcaccactctcacagtctcctca

SEQ ID NO: 1196 - protein, 137 aa, Artificial Sequence
  Description of Artificial Sequence: Synthetic 76E1 heavy chain variable region with signal sequence
MGWTWIFILILSVTTGVHSEVQLLQSGPELEKPGASVKISCKASGYSFTGYNMNWVKQSNGKSLEWIGNIDPYYDYTSYNLKFKDKATLTVDKSSSTAYMQLKSLTSEDSAVYYCATSTMITPFDYWGQGTTLTVSS

SEQ ID NO: 1197 - DNA, 393 bp, Artificial Sequence
  Description of Artificial Sequence: Synthetic 76E1 light chain variable region with signal sequence
atgaagttgcctgttaggctgttggtgctgatgttctggattcctgcttccagcagtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcaacagagtggaggctgaagatctgggagtttattactgctttcaaggttcacatgttccgtggacgttcggtggaggcaccaagctggaaatcaaa

SEQ ID NO: 1198 - protein, 131 aa, Artificial Sequence
  Description of Artificial Sequence: Synthetic 76E1 light chain variable region with signal sequence
MKLPVRLLVLMFWIPASSSDVLMTQTPLSLPVSLGDQASISCRSSQSIVHSNGNTYLEWYLQKPGQSPKLLIYKVSNRFSGVPDRFSGSGSGTDFTLKINRVEAEDLGVYYCFQGSHVPWTFGGGTKLEIK

SEQ ID NO: 1199 - DNA, 408 bp, Artificial Sequence
  Description of Artificial Sequence: Synthetic 53A heavy chain variable region with signal sequence
atggaatggagttggatatttctctttctcctgtcaggaactgcaggtgtccactctgaggtccagctgcagcagtctggacctgagctggtaaagcctggggcttcagtgaagatgtcctgcaaggcttctggatacacattcactagctattttatgcactgggtgaagcagaagcctgggcagggccttgagtggattggatatatttatccttacaatgatggtactaagtacaatgagaagttcaaaggcaaggccacactgacttcagacaaatcctccagcacagcctacatggagctcagcagcctgacctctgaggactctgcggtctattactgtgcaagatttgattacgacaccctgcgatactggggccaaggcaccactctcacagtctcctca

SEQ ID NO: 1200 - protein, 136 aa, Artificial Sequence
  Description of Artificial Sequence: Synthetic 53A heavy chain variable region with signal sequence
MEWSWIFLFLLSGTAGVHSEVQLQQSGPELVKPGASVKMSCKASGYTFTSYFMHWVKQKPGQGLEWIGYIYPYNDGTKYNEKFKGKATLTSDKSSSTAYMELSSLTSEDSAVYYCARFDYDTLRYWGQGTTLTVSS

SEQ ID NO: 1201 - DNA, 396 bp, Artificial Sequence
  Description of Artificial Sequence: Synthetic 53A light chain variable region with signal sequence
atgaagctgcctgttctgctagtggtgctgctattgttcacgagtccagcctcaagtagtgatgttgttctgacccaaactccactctctctgcctgtcaatattggagatcaagcctctatctcttgcaagtctactaagagtcttctgaatagtgatggattcacttatttggactggtacctgcagaagccaggccagtctccacagctcctaatatatttggtttctaatcgattttctggagttccagacaggttcagtggcagtgggtcaggaacagatttcacactcaagatcagcagagtggaggctgaggatttgggagtttattattgcttccagagtaactattttccgtggacgttcggtggaggcaccaagctggaaatcaaa

SEQ ID NO: 1202 - protein, 132 aa, Artificial Sequence
  Description of Artificial Sequence: Synthetic 53A light chain variable region with signal sequence
MKLPVLLVVLLLFTSPASSSDVVLTQTPLSLPVNIGDQASISCKSTKSLLNSDGFTYLDWYLQKPGQSPQLLIYLVSNRFSGVPDRFSGSGSGTDFTLKISRVEAEDLGVYYCFQSNYFPWTFGGGTKLEIK

SEQ ID NO: 1203 - DNA, 408 bp, Artificial Sequence
  Description of Artificial Sequence: Synthetic 259A heavy chain variable region with signal sequence
atggaatggagttggatatttctctttctcctgtcaggaactgcaggtgtccactctgaggtccagctgcagcagtctggacctgagctggtaaagcctggggcttcagtgaagatgtcctgcaaggcttctggatacacattcactagctattttatgcactgggtgaagcagaagcctgggcagggccttgagtggattggatatatttatccttacaatgatggtactaagtacaatgagaagttcaaaggcaaggccacactgacttcagacaaatcctccagcacagcctacatggacctcagcagcctgacctctgaagactctgcggtctattactgtgcaagatttgattacgacaccctgcgatactggggccaaggcaccactctcacagtctcctca

SEQ ID NO: 1204 - protein, 136 aa, Artificial Sequence
  Description of Artificial Sequence: Synthetic 259A heavy chain variable region with signal sequence
MEWSWIFLFLLSGTAGVHSEVQLQQSGPELVKPGASVKMSCKASGYTFTSYFMHWVKQKPGQGLEWIGYIYPYNDGTKYNEKFKGKATLTSDKSSSTAYMDLSSLTSEDSAVYYCARFDYDTLRYWGQGTTLTVSS

SEQ ID NO: 1205 - DNA, 396 bp, Artificial Sequence
  Description of Artificial Sequence: Synthetic 259A light chain variable region with signal sequence
atgaagctgcctgttctgctagtggtgctgctattgttcacgagtccagcctcaagtagtgatgttgttctgacccaaactccactctctctgcctgtcaatattggagatcaagcctctatctcttgcaagtctactaagagtcttctgaatagtgatggattcacttatttggactggtacctgcagaagccaggccagtctccacagctcctaatatatttgatttctaatcgattttctggagttccagacaggttcagtggcagtgggtcaggaacagatttcacactcaagatcagcagagtggaggctgaggatttgggagtttattattgcttccagagtaactattttccgtggacgttcggtggaggcaccaagctggaaatcaaa

SEQ ID NO: 1206 - protein, 132 aa, Artificial Sequence
  Description of Artificial Sequence: Synthetic 259A light chain variable region with signal sequence
MKLPVLLVVLLLFTSPASSSDVVLTQTPLSLPVNIGDQASISCKSTKSLLNSDGFTYLDWYLQKPGQSPQLLIYLISNRFSGVPDRFSGSGSGTDFTLKISRVEAEDLGVYYCFQSNYFPWTFGGGTKLEIK

SEQ ID NO: 1207 - DNA, 414 bp, Artificial Sequence
  Description of Artificial Sequence: Synthetic 33A heavy chain variable region with signal sequence
atggaatggacctgggtctttctcttcctcctgtcagtaactgcaggtgtccactcccaggttcagctgcagcagtctggagctgagctgatgaagcctggggcctcagtgaagatatcctgcaaggctactggctacacattcagtagctactggatagagtgggtaaagcagaggcctggacatggccttgagtggattggagagattttacctggaagtggtagtactagctacaatgagaagttcaagggcaaggccacattcactgcagatacatcctccaacacagcctacatgcaactcagcggcctgacatctgaggactctgccgtctattactgtgcaagatggttactatattactatgctatggtctactggggtcaaggaacctcagtcaccgtctcctca

SEQ ID NO: 1208 - protein, 138 aa, Artificial Sequence
  Description of Artificial Sequence: Synthetic 33A heavy chain variable region with signal sequence
MEWTWVFLFLLSVTAGVHSQVQLQQSGAELMKPGASVKISCKATGYTFSSYWIEWVKQRPGHGLEWIGEILPGSGSTSYNEKFKGKATFTADTSSNTAYMQLSGLTSEDSAVYYCARWLLYYYAMVYWGQGTSVTVSS

SEQ ID NO: 1209 - DNA, 393 bp, Artificial Sequence
  Description of Artificial Sequence: Synthetic 33A light chain variable region with signal sequence
atgaagttgcctgttaggctgttggtgctgatgttctggattcctgcttccagcagtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtacacgttcggaggggggaccaagctggaaataaaa

SEQ ID NO: 1210 - protein, 131 aa, Artificial Sequence
  Description of Artificial Sequence: Synthetic 33A light chain variable region with signal sequence
MKLPVRLLVLMFWIPASSSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 1211 - DNA, 414 bp, Artificial Sequence
  Description of Artificial Sequence: Synthetic 39A heavy chain variable region with signal sequence
atggaatggacctgggtctgtctcttcctcctgtcagtaactgcaggtgtccactcccaggttcagctgcagcagtctggagctgagctgatgaagcctggggcctcagtgaagatatcctgcaaggctactggctacacattcagtagtaactggatagagtgggtaaagcagaggcctggacatggccttgagtggattggagagattttacctggaagtggcagtactagctacaatgagaagttcaagggcaaggccacattcactgcagatacatcctccaacacagcctacatgcagctcagcagcctgacatctgaagactctgccgtctattactgtgcaagatggttactatattactatgctatggactactggggtcaaggaacctcagtcaccgtctcctca

SEQ ID NO: 1212 - protein, 138 aa, Artificial Sequence
  Description of Artificial Sequence: Synthetic 39A heavy chain variable region with signal sequence
MEWTWVCLFLLSVTAGVHSQVQLQQSGAELMKPGASVKISCKATGYTFSSNWIEWVKQRPGHGLEWIGEILPGSGSTSYNEKFKGKATFTADTSSNTAYMQLSSLTSEDSAVYYCARWLLYYYAMDYWGQGTSVTVSS

SEQ ID NO: 1213 - DNA, 393 bp, Artificial Sequence
  Description of Artificial Sequence: Synthetic 39A light chain variable region with signal sequence
atgaagttgcctgttaggctgttggtgctgatgttctggattcctgcttccagcagtgatgttttgatgacccaaactccactctccctgcctgtcagtcttggagatccagcctccatctcttgcagatctagtcagagcattgtacataataatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtacacgttcggaggggggaccaagctggaaataaaa

SEQ ID NO: 1214 - protein, 131 aa, Artificial Sequence
  Description of Artificial Sequence: Synthetic 39A light chain variable region with signal sequence
MKLPVRLLVLMFWIPASSSDVLMTQTPLSLPVSLGDPASISCRSSQSIVHNNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 1215 - DNA, 414 bp, Artificial Sequence
  Description of Artificial Sequence: Synthetic 124A heavy chain variable region with signal sequence
atggaatggacctgggtctttctcttcctcctgtcagtaactgcaggtgtccactcccaggttcagctgcagcagtctggagctgagctgatgaagcctggggcctcagtgaagatatcctgcaaggctactggctacacattcagtagcaactggatagagtgggtaaagcagaggcctggacatggccttgagtggatgggagagattttacctggaagtggcagtactagctacaatgagaagttcaagggcaaggccacattcactgcagatacatcctccaacacagcctacatgcagctcagcagcctgacatctgaagactctgccgtctattactgtgcaagatggttactatattactatgctatggacttctggggtcaaggaacctcagtcaccgtctcctca

SEQ ID NO: 1216 - protein, 138 aa, Artificial Sequence
  Description of Artificial Sequence: Synthetic 124A heavy chain variable region with signal sequence
MEWTWVFLFLLSVTAGVHSQVQLQQSGAELMKPGASVKISCKATGYTFSSNWIEWVKQRPGHGLEWMGEILPGSGSTSYNEKFKGKATFTADTSSNTAYMQLSSLTSEDSAVYYCARWLLYYYAMDFWGQGTSVTVSS

SEQ ID NO: 1217 - DNA, 393 bp, Artificial Sequence
  Description of Artificial Sequence: Synthetic 124A light chain variable region with signal sequence
atgaagttgcctgttaggctgttggtgctgatgttctggattcctgcttccagcagtgatgttttgatgacccaaactccactctccctgcctgtcagtcttggagatcaagcctccatctcttgcagatctagtcagagcattgtacataataatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgtacacgttcggaggggggaccaagctggaaataaaa

SEQ ID NO: 1218 - protein, 131 aa, Artificial Sequence
  Description of Artificial Sequence: Synthetic 124A light chain variable region with signal sequence
MKLPVRLLVLMFWIPASSSDVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 1219 - DNA, 414 bp, Artificial Sequence
  Description of Artificial Sequence: Synthetic 175A heavy chain variable region with signal sequence
atggaatggacctgggtctttctcttcctcctgtcagtaactgcaggtgtccactcccaggttcagctgcagcagtctggagctgagctgatgaagcctggggcctcagtgaagatatcctgcaaggctactggctacacattcagtacccactggatagagtgggtaaagcagaggcctggacatggccttgagtggattggagagattttacctggaagtggtagtactagctacaatgagaagttcaagggcaaggccacattcactgcagatacatcctccaacacagcctacatgcaactcagcagcctgacatctgaggactctgccgtctattactgtgcaagatggttactatattactatgctatggactactggggtcaaggaacctcagtcaccgtctcctca

SEQ ID NO: 1220 - protein, 138 aa, Artificial Sequence
  Description of Artificial Sequence: Synthetic 175A heavy chain variable region with signal sequence
MEWTWVFLFLLSVTAGVHSQVQLQQSGAELMKPGASVKISCKATGYTFSTHWIEWVKQRPGHGLEWIGEILPGSGSTSYNEKFKGKATFTADTSSNTAYMQLSSLTSEDSAVYYCARWLLYYYAMDYWGQGTSVTVSS

SEQ ID NO: 1221 - DNA, 393 bp, Artificial Sequence
  Description of Artificial Sequence: Synthetic 175A light chain variable region with signal sequence
atgaagttgcctgttaggctgttggtgctgatgttctggattcctgcttccagcagtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaactttccaaccgattttctggggtcccagacaggttcagtggcagtggatcagggacagatttcacactcaagatcagcagagtggaggctgaggatctgggagtttattactgctttcaaggttcacattttccgtacacgttcggaggggggaccaagctggaaataaaa

SEQ ID NO: 1222 - protein, 131 aa, Artificial Sequence
  Description of Artificial Sequence: Synthetic 175A light chain variable region with signal sequence
MKLPVRLLVLMFWIPASSSDVLMTQTPLSLPVSLGDQASISCRSSQSIVHSNGNTYLEWYLQKPGQSPKLLIYKLSNRFSGVPDRFSGSGSGTDFTLKISRVEAEDLGVYYCFQGSHFPYTFGGGTKLEIK

SEQ ID NO: 1223 - DNA, 414 bp, Artificial Sequence
  Description of Artificial Sequence: Synthetic 321D heavy chain variable region with signal sequence
atggaatggacctgggtctttctcttcctcctgtcagtaactgcaggtgtccactcccaggttcagctgcagcagtctggagctgagctgatgaagcctggggccgcagtgaagatatcctgcaaggctactggctacacattcagtagccactggatagagtgggtaaagcagaggcctggacatggccttgagtggattggagagattttacctggaagtggtagtactgactacaatgagaagttcaagggcaaggccacattcactgcagatacatcctccaacacagcctacatgcaactcagcagcctgacatctgaggactctgccgtctattactgtgcaagatggttactatattactatgctatggactactggggtcaaggaacctcagtcaccgtctcctca

SEQ ID NO: 1224 - protein, 138 aa, Artificial Sequence
  Description of Artificial Sequence: Synthetic 321D heavy chain variable region with signal sequence
MEWTWVFLFLLSVTAGVHSQVQLQQSGAELMKPGAAVKISCKATGYTFSSHWIEWVKQRPGHGLEWIGEILPGSGSTDYNEKFKGKATFTADTSSNTAYMQLSSLTSEDSAVYYCARWLLYYYAMDYWGQGTSVTVSS

SEQ ID NO: 1225 - DNA, 393 bp, Artificial Sequence
  Description of Artificial Sequence: Synthetic 321D light chain variable region with signal sequence
atgaagttgcctgttaggctgttggtgctgatgttctggattcctgcttccagcagtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcaccagagtggaggctgaggatctgggagtttattactgctttcaaggttcacatgttccgttcacgttcggaggggggaccaagctggaaataaaa

SEQ ID NO: 1226 - protein, 131 aa, Artificial Sequence
  Description of Artificial Sequence: Synthetic 321D light chain variable region with signal sequence
MKLPVRLLVLMFWIPASSSDVLMTQTPLSLPVSLGDQASISCRSSQSIVHSNGNTYLEWYLQKPGQSPKLLIYKVSNRFSGVPDRFSGSGSGTDFTLKITRVEAEDLGVYYCFQGSHVPFTFGGGTKLEIK

SEQ ID NO: 1227 - DNA, 420 bp, Artificial Sequence
  Description of Artificial Sequence: Synthetic 141A heavy chain variable region with signal sequence
atggaatggacctgggtctttctcttcctcctgtcagtaactgcaggtgtccactcccaggttcagctgcagcagtctggagctgagctgatgaagcctggggcctcagtgaagatatcctgcaaggctactggctacacattcagtaggtactggatagagtgggtaaagcagaggcctggacatggccttgagtggattggagagattttacctggaagtggtagtactaactacaatgagaagttcaagggcaaggccacattcactgcagatacatcctccaacacagcctacatgcaactcagcagcctgacatctgaggactctgccgtctattactgtgcaggagaggaagtctatgatggttacccctggtttggttactggggccaagggactctggtcactgtctctgca

SEQ ID NO: 1228 - protein, 140 aa, Artificial Sequence
  Description of Artificial Sequence: Synthetic 141A heavy chain variable region with signal sequence
MEWTWVFLFLLSVTAGVHSQVQLQQSGAELMKPGASVKISCKATGYTFSRYWIEWVKQRPGHGLEWIGEILPGSGSTNYNEKFKGKATFTADTSSNTAYMQLSSLTSEDSAVYYCAGEEVYDGYPWFGYWGQGTLVTVSA

SEQ ID NO: 1229 - DNA, 384 bp, Artificial Sequence
  Description of Artificial Sequence: Synthetic 141A light chain variable region with signal sequence
atggattttcaagtgcagattttcagcttcctgctaatcagtgcttcagtcataatgtccagaggacaaattgttctctcccagtctccagcaatcctgtctgcatctccaggggagaaggtcacaatgacttgcagggccagctcaagtttaagttacatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagtagtaacccgtacacgttcggaggggggaccaagctggaaataaaa

SEQ ID NO: 1230 - protein, 128 aa, Artificial Sequence
  Description of Artificial Sequence: Synthetic 141A light chain variable region with signal sequence
MDFQVQIFSFLLISASVIMSRGQIVLSQSPAILSASPGEKVTMTCRASSSLSYMHWYQQKPGSSPKPWIYATSNLASGVPARFSGSGSGTSYSLTISRVEAEDAATYYCQQWSSNPYTFGGGTKLEIK

SEQ ID NO: 1231 - DNA, 420 bp, Artificial Sequence
  Description of Artificial Sequence: Synthetic 51A heavy chain variable region with signal sequence
atggaatggacctgggtctttctcttcctcctgtcagtaactgcaggtgtccactcccaggttcagctgcagcagtctggagctgagctgatgaagcctggggcctcagtgaagatatcctgcaaggctactggctacacattcagtaggtactggatagagtgggtaaagcagaggcctggacatggccttgagtggattggagagattttacctggaagtggtagtactaactacaatgagaagttcaagggcaaggccacattcactgcagatacatcctccaacacagcctacatgcaactcagcagcctgacatctgaggactctgccgtctattactgtgcaagcgaggaagtctatgatggttacccctggtttggttactggggccaagggactctggtcactgtctctgca

SEQ ID NO: 1232 - protein, 140 aa, Artificial Sequence
  Description of Artificial Sequence: Synthetic 51A heavy chain variable region with signal sequence
MEWTWVFLFLLSVTAGVHSQVQLQQSGAELMKPGASVKISCKATGYTFSRYWIEWVKQRPGHGLEWIGEILPGSGSTNYNEKFKGKATFTADTSSNTAYMQLSSLTSEDSAVYYCASEEVYDGYPWFGYWGQGTLVTVSA

SEQ ID NO: 1233 - DNA, 384 bp, Artificial Sequence
  Description of Artificial Sequence: Synthetic 51A light chain variable region with signal sequence
atggattttcaagtgcagattttcagcttcctgctaatcagtgcttcagtcataatgtccagaggacaaattgttctctcccagtctccagcaatcctgtctgcatctccaggggagaaggtcacaatgacttgcagggccagctcaagtttaagttacatgcactggtaccagcagaggccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagtagtaacccgtacacgttcggaggggggaccaagctggaaataaaa

SEQ ID NO: 1234 - protein, 128 aa, Artificial Sequence
  Description of Artificial Sequence: Synthetic 51A light chain variable region with signal sequence
MDFQVQIFSFLLISASVIMSRGQIVLSQSPAILSASPGEKVTMTCRASSSLSYMHWYQQRPGSSPKPWIYATSNLASGVPARFSGSGSGTSYSLTISRVEAEDAATYYCQQWSSNPYTFGGGTKLEIK

SEQ ID NO: 1235 - DNA, 423 bp, Artificial Sequence
  Description of Artificial Sequence: Synthetic 353A heavy chain variable region with signal sequence
atggattttgggctgattttttttattgttgctcttttaaaaggggtccagtgtgaggtgaagcttctcgagtctggaggtggcctggtgcagcctggaggatccctgaaactctcctgtgcagcctcaggattcgattttagtagatactggatgaattgggtccggcaggctccagggaaagggctagaatggattggagaaattaatccagatagcagtacgataaactatacgccatctctaaaggataaattcatcatctccagagacaacgccaaaaatacgctgtacctgcaaatgagcaaagtgagatatgaggacacagccctttattactgtgcaagaccgggggaaatttattactacggtagttactggtttgcttactggggccaagggactctggtcactgtctctgca

SEQ ID NO: 1236 - protein, 141 aa, Artificial Sequence
  Description of Artificial Sequence: Synthetic 353A heavy chain variable region with signal sequence
MDFGLIFFIVALLKGVQCEVKLLESGGGLVQPGGSLKLSCAASGFDFSRYWMNWVRQAPGKGLEWIGEINPDSSTINYTPSLKDKFIISRDNAKNTLYLQMSKVRYEDTALYYCARPGEIYYYGSYWFAYWGQGTLVTVSA

SEQ ID NO: 1237 - DNA, 393 bp, Artificial Sequence
  Description of Artificial Sequence: Synthetic 353A light chain variable region with signal sequence
atggagtcagacacactcctgctatgggtgctgctgctctgggttccaggctccactggtgacattgtgctcacccaatctccagcttctttggctgtgtctctagggcagagagccaccatctcctgcagagccagtgaaagtgttgaatattatggcacaagtttaatgcagtggttccaacagaaaccaggacagccacccaaactcctcatctatgctgcatccaacgtagaatctagggtccctgccaggtttagtggcagtgggtctgggacagacttcagcctcaacatccatcctgtggaggaggatgatattgcaatgtatttctgtcagcaaagtaggaaggatccttggacattcggtggaggcaccaagctggaaatcaaa

SEQ ID NO: 1238 - protein, 131 aa, Artificial Sequence
  Description of Artificial Sequence: Synthetic 353A light chain variable region with signal sequence
MESDTLLLWVLLLWVPGSTGDIVLTQSPASLAVSLGQRATISCRASESVEYYGTSLMQWFQQKPGQPPKLLIYAASNVESRVPARFSGSGSGTDFSLNIHPVEEDDIAMYFCQQSRKDPWTFGGGTKLEIK

SEQ ID NO: 1239 - DNA, 408 bp, Artificial Sequence
  Description of Artificial Sequence: Synthetic 305A heavy chain variable region with signal sequence
atgaaagtgttgagtctgttgtacctgttgacagccattcctggtatcctgtctgatgtacagcttcaggagtcaggacctggcctcgtgaaaccttctcagtctctgtctctcacctgctctgtcactggctactccatcaccagtggttattactggaactggatccggcagtttccaggaaacaaactggaatggatgggctacataagctacgacggtagcaataactacaacccatctctcaaaaatcgaatctccatcactcgtgacacatctaagaaccagtttttcctgaagttgaattctgtgactactgaggacacagctacatattactgtgcaagacggcatgattacctctcctttgcttactggggccaagggactctggtcattgtctctgca

SEQ ID NO: 1240 - protein, 136 aa, Artificial Sequence
  Description of Artificial Sequence: Synthetic 305A heavy chain variable region with signal sequence
MKVLSLLYLLTAIPGILSDVQLQESGPGLVKPSQSLSLTCSVTGYSITSGYYWNWIRQFPGNKLEWMGYISYDGSNNYNPSLKNRISITRDTSKNQFFLKLNSVTTEDTATYYCARRHDYLSFAYWGQGTLVIVSA

SEQ ID NO: 1241 - DNA, 393 bp, Artificial Sequence
  Description of Artificial Sequence: Synthetic 305A light chain variable region with signal sequence
atggagacagacacaatcctgctatgggtgctgctgctctgggttccaggctccactggtgacattgtgctgacccaatctccagcttctttggctgtgtctctagggcagagggccaccatctcctgcaaggccagccaaagtgttgattatgatggtgatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtgatgaggatccgtacacgttcggaggggggaccaagctggaaataaaa

SEQ ID NO: 1242 - protein, 131 aa, Artificial Sequence
  Description of Artificial Sequence: Synthetic 305A light chain variable region with signal sequence
METDTILLWVLLLWVPGSTGDIVLTQSPASLAVSLGQRATISCKASQSVDYDGDSYMNWYQQKPGQPPKLLIYAASNLESGIPARFSGSGSGTDFTLNIHPVEEEDAATYYCQQSDEDPYTFGGGTKLEIK

SEQ ID NO: 1243 - protein, 309 aa, Artificial Sequence
  Description of Artificial Sequence: Synthetic mouse C10orf54 protein encoded by the CC2 expression construct
MGVPAVPEASSPRWGTLLLAIFLAASRGLVAAFKVTTPYSLYVCPEGQNATLTCRILGPVSKGHDVTIYKTWYLSSRGEVQMCKEHRPIRNFTLQHLQHHGSHLKANASHDQPQKHGLELASDHHGNFSITLRNVTPRDSGLYCCLVIELKNHHPEQRFYGSMELQVQAGKGSGSTCMASNEQDSDSITAAALATGACIVGILCLPLILLLVYKQRQVASHRRAQELVRMDSSNTQGIENPGFETTPPFQGMPEAKTRPPLSYVAQRQPSESGRYLLSDPSTPLSPPGPGDVFFPSLDPVPDSPNSEAI

SEQ ID NO: 1244 - protein, 309 aa, Artificial Sequence
  Description of Artificial Sequence: Synthetic rat C10orf54 protein encoded by the CC3 expression construct
MGVPTVPEASSLRWGTLLLTIFLAASRGLVAAIKVTTPYSLYVCPEGQNVTLTCRILDSVSKGHDANFLKTWFLSSRGEVQVCKEHRPIRNFISHHQHHRSHPAVNASHDQPQKHGLEIAYDNHGNFSITLHNVTLSDSGLYCCLVIEVKHHHPERRLYGYMELQVQTGKGSASTCTAYPPNEQDSDSITAAALATGACIVGILCLPLILLLVYKQRQAASHRRAQELVRMDSNTQGIENPGYETTPPFQGMPEAKTRPPLSYVAQRQPSESGRHLLSDPSTPLSPPGPGDVFFPSLDPVPDSPNSEAI

SEQ ID NO: 1245 - protein, 311 aa, Artificial Sequence
  Description of Artificial Sequence: Synthetic cynomolgus C10orf54 protein encoded by the CC4 expression construct
MGVPTAPEAGCWRWGSLLFALFLAASLGPVAAFKVATLYSLYVCPEGQNVTLTCRVFGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSSCVAYPSSSQESENITAAALATGACIVGILCLPLILLLVYKQRQAASNRRAQELVRMDSNTQGIENPGFEASSPAQGILEAKVRHPLSYVAQRQPSESGRHLLSEPGTPLSPPGPGDVFFPSLDPVPDSPNFEVI

SEQ ID NO: 1246 - protein, 310 aa, Artificial Sequence
  Description of Artificial Sequence: Synthetic chimeric protein encoded by the CC5 expression construct
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQAGKGSGSTCMASNEQDSDSITAAALATGACIVGILCLPLILLLVYKQRQVASHRRAQELVRMDSSNTQGIENPGFETTPPFQGMPEAKTRPPLSYVAQRQPSESGRYLLSDPSTPLSPPGPGDVFFPSLDPVPDSPNSEAI

SEQ ID NO: 1247 - protein, 310 aa, Artificial Sequence
  Description of Artificial Sequence: Synthetic chimeric protein encoded by the CC6 expression construct
MGVPAVPEASSPRWGTLLLAIFLAASRGLVAAFKVTTPYSLYVCPEGQNATLTCRILGPVSKGHDVTIYKTWYLSSRGEVQMCKEHRPIRNFTLQHLQHHGSHLKANASHDQPQKHGLELASDHHGNFSITLRNVTPRDSGLYCCLVIELKNHHPEQRFYGSMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 1248 - protein, 309 aa, Artificial Sequence
  Description of Artificial Sequence: Synthetic chimeric protein encoded by the CC7 expression construct
MGVPTALEAGSWRWGSLLFALFLAASLGPVAAFKVATPYSLYVCPEGQNVTLTCRLLGPVDKGHDVTFYKTWYRSSRGEVQTCKEHRPIRNFTLQHLQHHGSHLKANASHDQPQKHGLELASDHHGNFSITLRNVTPRDSGLYCCLVIELKNHHPEQRFYGSMELQVQAGKGSGSTCMASNEQDSDSITAAALATGACIVGILCLPLILLLVYKQRQVASHRRAQELVRMDSSNTQGIENPGFETTPPFQGMPEAKTRPPLSYVAQRQPSESGRYLLSDPSTPLSPPGPGDVFFPSLDPVPDSPNSEAI

SEQ ID NO: 1249 - protein, 311 aa, Artificial Sequence
  Description of Artificial Sequence: Synthetic chimeric protein encoded by the CC8 expression construct
MGVPAVPEASSPRWGTLLLAIFLAASRGLVAAFKVTTPYSLYVCPEGQNATLTCRILGPVSKGHDVTIYKTWYLSSRGEVQMCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 1250 - protein, 310 aa, Artificial Sequence
  Description of Artificial Sequence: Synthetic chimeric protein encoded by the CC9 expression construct
MGVPTALEAGSWRWGSLLFALFLAASLGPVAAFKVATPYSLYVCPEGQNVTLTCRLLGPVDKGHDVTFYKTWYRSSRGEVQTCKEHRPIRNFTLQHLQHHGSHLKANASHDQPQKHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 1251 - protein, 310 aa, Artificial Sequence
  Description of Artificial Sequence: Synthetic chimeric protein encoded by the CC10 expression construct
MGVPAVPEASSPRWGTLLLAIFLAASRGLVAAFKVTTPYSLYVCPEGQNATLTCRILGPVSKGHDVTIYKTWYLSSRGEVQMCSERRPIRNLTFQDLHLHHGGHQAANTSHDLAQRHGLELASDHHGNFSITLRNVTPRDSGLYCCLVIELKNHHPEQRFYGSMELQVQAGKGSGSTCMASNEQDSDSITAAALATGACIVGILCLPLILLLVYKQRQVASHRRAQELVRMDSSNTQGIENPGFETTPPFQGMPEAKTRPPLSYVAQRQPSESGRYLLSDPSTPLSPPGPGDVFFPSLDPVPDSPNSEAI

SEQ ID NO: 1252 - protein, 117 aa, Artificial Sequence
  Description of Artificial Sequence: Synthetic VH domain of murine antibody 5B
QVQLQQSGAELVRPGVSVKISCKGSGYTFTDYGMHWVKQSHAKSLEWIGIIDTYYGDATYNQKFKGKATMTVDKSSSTAYMELARLTSEDSAIYYCARRAGNAMDYWGQGTSVTVSS

SEQ ID NO: 1253 - protein, 107 aa, Artificial Sequence
  Description of Artificial Sequence: Synthetic VL domain of murine antibody 5B
NIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPRTFGGGTKLEIK

SEQ ID NO: 1254 - protein, 117 aa, Artificial Sequence
  Description of Artificial Sequence: Synthetic VH domain of murine antibody 46A
QVQLQQAGGELVRPGVSVKISCKGSGYTFTDYGMHWVKQSHAKSLEWIGIINTYYGDATYNQKFKGKATMTVDKSSSTAYMELARLTSEDSAIYYCARRAGTAMDYWGQGTSVTVSS

SEQ ID NO: 1255 - protein, 107 aa, Artificial Sequence
  Description of Artificial Sequence: Synthetic VL domain of murine antibody 46A
SIVMTQTPKFLLVSAGDRVTITCKASQSVSNDVAWYQQKPGQSPKLLIYYASNRYTGVPDRFTGSGYGTDFTFTISTVQAEDLAVYFCQQDYGSPRTFGGGTKLEIK

SEQ ID NO: 1256 - protein, 117 aa, Artificial Sequence
  Description of Artificial Sequence: Synthetic VH domain of murine antibody 97A
QVQLQQSGAELVRPGVSVKISCKGSGYTFTDYGMHWVKQSHAKSLEWIGVIDTYYGDASNNQKFKGKATMTVDKSSSTAYMELARLTSEDSAIYYCARRAGNAMDYWGQGTSVTVSS

SEQ ID NO: 1257 - protein, 107 aa, Artificial Sequence
  Description of Artificial Sequence: Synthetic VL domain of murine antibody 97A
SIVMTQTPKFLLVSAGDRVAITCKASQSVSNDVAWYQQKPGQSPKLLIYYASNRYTGVPDRFTGSGYGTDFTFTISTVQAEDLAVYFCQQDYGSPRTFGGGTKLEIK

SEQ ID NO: 1258 - protein, 117 aa, Artificial Sequence
  Description of Artificial Sequence: Synthetic VH domain of murine antibody 128A
QVQLQQSGAELVRPGVSVKISCKGSGYTFTDYGMHWVKQSHAKSLEWIGLIDTYYGDATYNHKFKGKATMTVDKSSRTAYMELARLTSEDSAIYYCARRAGNAMDYWGQGTSVTASS

SEQ ID NO: 1259 - protein, 107 aa, Artificial Sequence
  Description of Artificial Sequence: Synthetic VL domain of murine antibody 128A
NIAMTQTPKFLLVSAGDRVTITCKASQSVSNDIAWYQQKPGQSPRLLIYYASNRYTGVPDRFTGSGYGTDFTFTISTVQAEDLAVYFCQQDYSSPRTFGGGTKLEIK

SEQ ID NO: 1260 - protein, 117 aa, Artificial Sequence; identical to SEQ ID NO: 1258
  Description of Artificial Sequence: Synthetic VH domain of murine antibody 146C

SEQ ID NO: 1261 - protein, 107 aa, Artificial Sequence; identical to SEQ ID NO: 1259
  Description of Artificial Sequence: Synthetic VL domain of murine antibody 146C

SEQ ID NO: 1262 - protein, 117 aa, Artificial Sequence
  Description of Artificial Sequence: Synthetic VH domain of murine antibody 208A
QVQLQQSGAELVRPGVSVKISCKGSGYTFTDYGMHWVKQSHAKSLEWIGVIDTYYGDAGYNQKFKGKATMTVDKSSSTAYMELARLTSEDSAIYYCARRAGNAMDYWGQGTSVTVSS

SEQ ID NO: 1263 - protein, 107 aa, Artificial Sequence
  Description of Artificial Sequence: Synthetic VL domain of murine antibody 208A
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPRTFGGGTKLEIK

SEQ ID NO: 1264 - protein, 118 aa, Artificial Sequence
  Description of Artificial Sequence: Synthetic VH domain of murine antibody 215A
EVQLQQSGPELVKPGASMKISCKASGFSFTGYTMNWVKQSHGKNLEWIGLISPYNGGTSYNQKFKGKATLTVDKSSSTAYMELLSLTSEDSAVYYCARRAYGYAMDYWGQGTSVTVSS

SEQ ID NO: 1265 - protein, 106 aa, Artificial Sequence
  Description of Artificial Sequence: Synthetic VL domain of murine antibody 215A
QIVLTQSPAIMSASPGEKVTMTCSASSSVSYMFWYQQKPGSSPRLLIYDTSNLASGVPLRFSGSGSGTSYSLTISRMEAEDAATYYCQQWSSYPFTFGSGTKLEIK

SEQ ID NO: 1266 - protein, 118 aa, Artificial Sequence
  Description of Artificial Sequence: Synthetic VH domain of murine antibody 26A
EVQLQQSGPELVKPGASMKISCKASGFSFTGYTMNWVKQSHVKNLEWIGLISPYNGGTSYNQKFKGKATLTVDKSSSTAYMELLSLTSEDSAVYYCARRAYGYAMDYWGQGTSVTVSS

SEQ ID NO: 1267 - protein, 106 aa, Artificial Sequence
  Description of Artificial Sequence: Synthetic VL domain of murine antibody 26A
QIVLTQSPAIMSASPGEKVTMTCSASSSVSYMYWYQQKPGSSPRLLIYDTSNLASGVPLRFSGSGSGTSYSLTISRMEAEDAATYYCQQWSSYPFTFGSGTKLEIK

SEQ ID NO: 1268 - protein, 120 aa, Artificial Sequence
  Description of Artificial Sequence: Synthetic VH domain of murine antibody 164A
EVQLQQSGPELEKPGASVKISCKASGYSFTGYNMNWVKQSNGKSLEWIGNIDPYYGSASYNQKFKGKATLTVDKSSTTAYMQLKSLTSEDSAVYYCTRSNYGYYGYFDVWGAGTTVTVSS

SEQ ID NO: 1269 - protein, 112 aa, Artificial Sequence
  Description of Artificial Sequence: Synthetic VL domain of murine antibody 164A
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQFLSSYTFGGGTKLEMK

SEQ ID NO: 1270 - protein, 108 aa, Artificial Sequence
  Description of Artificial Sequence: Synthetic VL domain of murine antibody 164A sequence no. 2
ENVLTQSPAIMAASPGEKVTMTCSASSSVSSSNLHWYQQKSGTSTKFWIYRTSNLASEVPAPFSGSGSGTSYSLTISSVEAEDAATYYCQQWSGYPRTFGGGTKLEIK

SEQ ID NO: 1271 - protein, 120 aa, Artificial Sequence
  Description of Artificial Sequence: Synthetic VH domain of murine antibody 230A
EVQLQQSGPELEKPGASVKISCKASGYSFTGSNMNWVKQNNGKSLEWIGNIDPYYGYTTYNQKFKGKATLTVDKSSSTAYMQLKSLTSEDSAVYYCARDYDYALGYFDVWGAGTTVTVSS

SEQ ID NO: 1272 - protein, 112 aa, Artificial Sequence
  Description of Artificial Sequence: Synthetic VL domain of murine antibody 230A
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 1273 - protein, 117 aa, Artificial Sequence
  Description of Artificial Sequence: Synthetic VH domain of murine antibody 53A
EVQLQQSGPELVKPGASVKMSCKASGYTFTSYFMHWVKQKPGQGLEWIGYIYPYNDGTKYNEKFKGKATLTSDKSSSTAYMELSSLTSEDSAVYYCARFDYDTLRYWGQGTTLTVSS

SEQ ID NO: 1274 - protein, 112 aa, Artificial Sequence
  Description of Artificial Sequence: Synthetic VL domain of murine antibody 53A
DVVLTQTPLSLPVNIGDQASISCKSTKSLLNSDGFTYLDWYLQKPGQSPQLLIYLVSNRFSGVPDRFSGSGSGTDFTLKISRVEAEDLGVYYCFQSNYFPWTFGGGTKLEIK

SEQ ID NO: 1275 - protein, 117 aa, Artificial Sequence
  Description of Artificial Sequence: Synthetic VH domain of murine antibody 259A
EVQLQQSGPELVKPGASVKMSCKASGYTFTSYFMHWVKQKPGQGLEWIGYIYPYNDGTKYNEKFKGKATLTSDKSSSTAYMDLSSLTSEDSAVYYCARFDYDTLRYWGQGTTLTVSS

SEQ ID NO: 1276 - protein, 112 aa, Artificial Sequence
  Description of Artificial Sequence: Synthetic VL domain of murine antibody 259A
DVVLTQTPLSLPVNIGDQASISCKSTKSLLNSDGFTYLDWYLQKPGQSPQLLIYLISNRFSGVPDRFSGSGSGTDFTLKISRVEAEDLGVYYCFQSNYFPWTFGGGTKLEIK

SEQ ID NO: 1277 - protein, 119 aa, Artificial Sequence
  Description of Artificial Sequence: Synthetic VH domain of murine antibody 33A
QVQLQQSGAELMKPGASVKISCKATGYTFSSYWIEWVKQRPGHGLEWIGEILPGSGSTSYNEKFKGKATFTADTSSNTAYMQLSGLTSEDSAVYYCARWLLYYYAMVYWGQGTSVTVSS

SEQ ID NO: 1278 - protein, 112 aa, Artificial Sequence
  Description of Artificial Sequence: Synthetic VL domain of murine antibody 33A
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 1279 - protein, 119 aa, Artificial Sequence
  Description of Artificial Sequence: Synthetic VH domain of murine antibody 39A
QVQLQQSGAELMKPGASVKISCKATGYTFSSNWIEWVKQRPGHGLEWIGEILPGSGSTSYNEKFKGKATFTADTSSNTAYMQLSSLTSEDSAVYYCARWLLYYYAMDYWGQGTSVTVSS

SEQ ID NO: 1280 - protein, 112 aa, Artificial Sequence
  Description of Artificial Sequence: Synthetic VL domain of murine antibody 39A
DVLMTQTPLSLPVSLGDPASISCRSSQSIVHNNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 1281 - protein, 119 aa, Artificial Sequence
  Description of Artificial Sequence: Synthetic VH domain of murine antibody 124A
QVQLQQSGAELMKPGASVKISCKATGYTFSSNWIEWVKQRPGHGLEWMGEILPGSGSTSYNEKFKGKATFTADTSSNTAYMQLSSLTSEDSAVYYCARWLLYYYAMDFWGQGTSVTVSS

SEQ ID NO: 1282 - protein, 112 aa, Artificial Sequence
  Description of Artificial Sequence: Synthetic VL domain of murine antibody 124A
DVLMTQTPLSLPVSLGDQASISCRSSQSIVHNNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 1283 - protein, 119 aa, Artificial Sequence
  Description of Artificial Sequence: Synthetic VH domain of murine antibody 321D
QVQLQQSGAELMKPGAAVKISCKATGYTFSSHWIEWVKQRPGHGLEWIGEILPGSGSTDYNEKFKGKATFTADTSSNTAYMQLSSLTSEDSAVYYCARWLLYYYAMDYWGQGTSVTVSS

SEQ ID NO: 1284 - protein, 112 aa, Artificial Sequence
  Description of Artificial Sequence: Synthetic VL domain of murine antibody 321D
DVLMTQTPLSLPVSLGDQASISCRSSQSIVHSNGNTYLEWYLQKPGQSPKLLIYKVSNRFSGVPDRFSGSGSGTDFTLKITRVEAEDLGVYYCFQGSHVPFTFGGGTKLEIK

SEQ ID NO: 1285 - protein, 121 aa, Artificial Sequence
  Description of Artificial Sequence: Synthetic VH domain of murine antibody 51A
QVQLQQSGAELMKPGASVKISCKATGYTFSRYWIEWVKQRPGHGLEWIGEILPGSGSTNYNEKFKGKATFTADTSSNTAYMQLSSLTSEDSAVYYCASEEVYDGYPWFGYWGQGTLVTVSA

SEQ ID NO: 1286 - protein, 106 aa, Artificial Sequence
  Description of Artificial Sequence: Synthetic VL domain of murine antibody 51A
QIVLSQSPAILSASPGEKVTMTCRASSSLSYMHWYQQRPGSSPKPWIYATSNLASGVPARFSGSGSGTSYSLTISRVEAEDAATYYCQQWSSNPYTFGGGTKLEIK

SEQ ID NO: 1287 - protein, 123 aa, Artificial Sequence
  Description of Artificial Sequence: Synthetic VH domain of murine antibody 353A
EVKLLESGGGLVQPGGSLKLSCAASGFDFSRYWMNWVRQAPGKGLEWIGEINPDSSTINYTPSLKDKFIISRDNAKNTLYLQMSKVRYEDTALYYCARPGEIYYYGSYWFAYWGQGTLVTVSA

SEQ ID NO: 1288 - protein, 111 aa, Artificial Sequence
  Description of Artificial Sequence: Synthetic VL domain of murine antibody 353A
DIVLTQSPASLAVSLGQRATISCRASESVEYYGTSLMQWFQQKPGQPPKLLIYAASNVESRVPARFSGSGSGTDFSLNIHPVEEDDIAMYFCQQSRKDPWTFGGGTKLEIK

SEQ ID NO: 1289 - protein, 118 aa, Artificial Sequence
  Description of Artificial Sequence: Synthetic VH domain of murine antibody 305A
DVQLQESGPGLVKPSQSLSLTCSVTGYSITSGYYWNWIRQFPGNKLEWMGYISYDGSNNYNPSLKNRISITRDTSKNQFFLKLNSVTTEDTATYYCARRHDYLSFAYWGQGTLVIVSA

SEQ ID NO: 1290 - protein, 111 aa, Artificial Sequence
  Description of Artificial Sequence: Synthetic VL domain of murine antibody 305A
DIVLTQSPASLAVSLGQRATISCKASQSVDYDGDSYMNWYQQKPGQPPKLLIYAASNLESGIPARFSGSGSGTDFTLNIHPVEEEDAATYYCQQSDEDPYTFGGGTKLEIK

SEQ ID NO: 1291 - protein, 10 aa, Artificial Sequence
  Description of Artificial Sequence: Synthetic h128A VH CDR1
GYTFTDYGMH

SEQ ID NO: 1292 - protein, 8 aa, Artificial Sequence
  Description of Artificial Sequence: Synthetic 5B VH CDR1 according to IMGT
GYTFTDYG

SEQ ID NO: 1293 - protein, 5 aa, Artificial Sequence
  Description of Artificial Sequence: Synthetic 5B VH CDR1 according to Kabat
DYGMH

SEQ ID NO: 1294 - protein, 7 aa, Artificial Sequence
  Description of Artificial Sequence: Synthetic 5B VH CDR1 according to Chothia
GYTFTDY

SEQ ID NO: 1295 - protein, 6 aa, Artificial Sequence
  Description of Artificial Sequence: Synthetic 5B VH CDR1 according to Contact
TDYGMH

SEQ ID NO: 1296 - protein, 10 aa, Artificial Sequence
  Description of Artificial Sequence: Synthetic 215A VH CDR1 Exemplary sequence
GFSFTGYTMN

SEQ ID NO: 1297 - protein, 8 aa, Artificial Sequence
  Description of Artificial Sequence: Synthetic 215A VH CDR1 according to IMGT
GFSFTGYT

SEQ ID NO: 1298 - protein, 5 aa, Artificial Sequence
  Description of Artificial Sequence: Synthetic 215A VH CDR1 according to Kabat
GYTMN

SEQ ID NO: 1299 - protein, 7 aa, Artificial Sequence
  Description of Artificial Sequence: Synthetic 215A VH CDR1 according to Chothia
GFSFTGY

SEQ ID NO: 1300 - protein, 6 aa, Artificial Sequence
  Description of Artificial Sequence: Synthetic 215A VH CDR1 according to Contact
TGYTMN

SEQ ID NO: 1301 - protein, 10 aa, Artificial Sequence
  Description of Artificial Sequence: Synthetic 230A VH CDR1 exemplary sequence
GYSFTGSNMN

SEQ ID NO: 1302 - protein, 8 aa, Artificial Sequence
  Description of Artificial Sequence: Synthetic 230A VH CDR1 according to IMGT
GYSFTGSN

SEQ ID NO: 1303 - protein, 5 aa, Artificial Sequence
  Description of Artificial Sequence: Synthetic 230A VH CDR1 according to Kabat
GSNMN

SEQ ID NO: 1304 - protein, 7 aa, Artificial Sequence
  Description of Artificial Sequence: Synthetic 230A VH CDR1 according to Chothia
GYSFTGS

SEQ ID NO: 1305 - protein, 6 aa, Artificial Sequence
  Description of Artificial Sequence: Synthetic 230A VH CDR1 according to Contact
TGSNMN

SEQ ID NO: 1306 - protein, 10 aa, Artificial Sequence
  Description of Artificial Sequence: Synthetic 53A VH CDR1 exemplary sequence
GYTFTSYFMH

SEQ ID NO: 1307 - protein, 8 aa, Artificial Sequence
  Description of Artificial Sequence: Synthetic 53A VH CDR1 according to IMGT
GYTFTSYF

SEQ ID NO: 1308 - protein, 5 aa, Artificial Sequence
  Description of Artificial Sequence: Synthetic 53A VH CDR1 according to Kabat
SYFMH

SEQ ID NO: 1309 - protein, 7 aa, Artificial Sequence
  Description of Artificial Sequence: Synthetic 53A VH CDR1 according to Chothia
GYTFTSY

SEQ ID NO: 1310 - protein, 6 aa, Artificial Sequence
  Description of Artificial Sequence: Synthetic 53A VH CDR1 according to Contact
TSYFMH

SEQ ID NO: 1311 - protein, 10 aa, Artificial Sequence
  Description of Artificial Sequence: Synthetic 33A VH CDR1 exemplary sequence
GYTFSSYWIE

SEQ ID NO: 1312 - protein, 8 aa, Artificial Sequence
  Description of Artificial Sequence: Synthetic 33A VH CDR1 according to IMGT
GYTFSSYW

SEQ ID NO: 1313 - protein, 5 aa, Artificial Sequence
  Description of Artificial Sequence: Synthetic 33A VH CDR1 according to Kabat
SYWIE

SEQ ID NO: 1314 - protein, 7 aa, Artificial Sequence
  Description of Artificial Sequence: Synthetic 33A VH CDR1 according to Chothia
GYTFSSY

SEQ ID NO: 1315 - protein, 6 aa, Artificial Sequence
  Description of Artificial Sequence: Synthetic 33A VH CDR1 according to Contact
SSYWIE

SEQ ID NO: 1316 - protein, 10 aa, Artificial Sequence
  Description of Artificial Sequence: Synthetic 39A VH CDR1 exemplary sequence
GYTFSSNWIE

SEQ ID NO: 1317 - protein, 8 aa, Artificial Sequence
  Description of Artificial Sequence: Synthetic 39A VH CDR1 according to IMGT
GYTFSSNW

SEQ ID NO: 1318 - protein, 5 aa, Artificial Sequence
  Description of Artificial Sequence: Synthetic 39A VH CDR1 according to Kabat
SNWIE

SEQ ID NO: 1319 - protein, 7 aa, Artificial Sequence
  Description of Artificial Sequence: Synthetic 39A VH CDR1 according to Chothia
GYTFSSN

SEQ ID NO: 1320 - protein, 6 aa, Artificial Sequence
  Description of Artificial Sequence: Synthetic 39A VH CDR1 according to Contact
SSNWIE

SEQ ID NO: 1321 - protein, 10 aa, Artificial Sequence
  Description of Artificial Sequence: Synthetic 321D VH CDR1 exemplary sequence
GYTFSSHWIE

SEQ ID NO: 1322 - protein, 8 aa, Artificial Sequence
  Description of Artificial Sequence: Synthetic 321D VH CDR1 according to IMGT
GYTFSSHW

SEQ ID NO: 1323 - protein, 5 aa, Artificial Sequence
  Description of Artificial Sequence: Synthetic 321D VH CDR1 according to Kabat
SHWIE

SEQ ID NO: 1324 - protein, 7 aa, Artificial Sequence
  Description of Artificial Sequence: Synthetic 321D VH CDR1 according to Chothia
GYTFSSH

SEQ ID NO: 1325 - protein, 6 aa, Artificial Sequence
  Description of Artificial Sequence: Synthetic 321D VH CDR1 according to Contact
SSHWIE

SEQ ID NO: 1326 - protein, 10 aa, Artificial Sequence
  Description of Artificial Sequence: Synthetic 353A VH CDR1 exemplary sequence
GFDFSRYWMN

SEQ ID NO: 1327 - protein, 8 aa, Artificial Sequence
  Description of Artificial Sequence: Synthetic 353A VH CDR1 according to IMGT
GFDFSRYW

SEQ ID NO: 1328 - protein, 5 aa, Artificial Sequence
  Description of Artificial Sequence: Synthetic 353A VH CDR1 according to Kabat
RYWMN

SEQ ID NO: 1329 - protein, 7 aa, Artificial Sequence
  Description of Artificial Sequence: Synthetic 353A VH CDR1 according to Chothia
GFDFSRY

SEQ ID NO: 1330 - protein, 6 aa, Artificial Sequence
  Description of Artificial Sequence: Synthetic 353A VH CDR1 according to Contact
SRYWMN

SEQ ID NO: 1331 - protein, 11 aa, Artificial Sequence
  Description of Artificial Sequence: Synthetic 305A VH CDR1 exemplary sequence
GYSITSGYYWN

SEQ ID NO: 1332 - protein, 9 aa, Artificial Sequence
  Description of Artificial Sequence: Synthetic 305A VH CDR1 according to IMGT
GYSITSGYY

SEQ ID NO: 1333 - protein, 6 aa, Artificial Sequence
  Description of Artificial Sequence: Synthetic 305A VH CDR1 according to Kabat
SGYYWN

SEQ ID NO: 1334 - protein, 8 aa, Artificial Sequence
  Description of Artificial Sequence: Synthetic 305A VH CDR1 according to Chothia
GYSITSGY

SEQ ID NO: 1335 - protein, 7 aa, Artificial Sequence
  Description of Artificial Sequence: Synthetic 305A VH CDR1 according to Contact
TSGYYWN

SEQ ID NO: 1336 - protein, 17 aa, Artificial Sequence
  Description of Artificial Sequence: Synthetic 5B VH CDR2 exemplary sequence
IIDTYYGDATYNQKFKG

SEQ ID NO: 1337 - protein, 8 aa, Artificial Sequence
  Description of Artificial Sequence: Synthetic 5B VH CDR2 according to IMGT
IDTYYGDA

SEQ ID NO: 1338 - protein, 4 aa, Artificial Sequence
  Description of Artificial Sequence: Synthetic 5B VH CDR2 according to Chothia
TYYG

SEQ ID NO: 1339 - protein, 13 aa, Artificial Sequence
  Description of Artificial Sequence: Synthetic 5B VH CDR2 according to Contact
WIGIIDTYYGDAT

SEQ ID NO: 1340 - protein, 10 aa, Artificial Sequence
  Description of Artificial Sequence: Synthetic 5B VH CDR2 according to AbM
IIDTYYGDAT

SEQ ID NO: 1341 - protein, 17 aa, Artificial Sequence
  Description of Artificial Sequence: Synthetic 46A VH CDR2 exmeplary sequence
IINTYYGDATYNQKFKG

SEQ ID NO: 1342 - protein, 8 aa, Artificial Sequence
  Description of Artificial Sequence: Synthetic 46A VH CDR2 according to IMGT
INTYYGDA

SEQ ID NO: 1343 - protein, 13 aa, Artificial Sequence
  Description of Artificial Sequence: Synthetic 46A VH CDR2 according to Contact
WIGIINTYYGDAT

SEQ ID NO: 1344 - protein, 10 aa, Artificial Sequence
  Description of Artificial Sequence: Synthetic 46A VH CDR2 according to AbM
IINTYYGDAT

SEQ ID NO: 1345 - protein, 17 aa, Artificial Sequence
  Description of Artificial Sequence: Synthetic 97A VH CDR2 exemplary sequence
VIDTYYGDASNNQKFKG

SEQ ID NO: 1346 - protein, 13 aa, Artificial Sequence
  Description of Artificial Sequence: Synthetic 97A VH CDR2 according to Contact
WIGVIDTYYGDAS

SEQ ID NO: 1347 - protein, 10 aa, Artificial Sequence
  Description of Artificial Sequence: Synthetic 97A VH CDR2 according to AbM
VIDTYYGDAS

SEQ ID NO: 1348 - protein, 17 aa, Artificial Sequence
  Description of Artificial Sequence: Synthetic 128A VH CDR2 exemplary sequence
LIDTYYGDATYNHKFKG

SEQ ID NO: 1349 - protein, 13 aa, Artificial Sequence
  Description of Artificial Sequence: Synthetic 128A VH CDR2 according to Contact
WIGLIDTYYGDAT

SEQ ID NO: 1350 - protein, 10 aa, Artificial Sequence
  Description of Artificial Sequence: Synthetic 128A VH CDR2 according to AbM
LIDTYYGDAT

SEQ ID NO: 1351 - protein, 17 aa, Artificial Sequence
  Description of Artificial Sequence: Synthetic 108A VH CDR2 exemplary sequence
VIDTYYGDAGYNQKFKG

SEQ ID NO: 1352 - protein, 13 aa, Artificial Sequence
  Description of Artificial Sequence: Synthetic 208A VH CDR2 according to Contact
WIGVIDTYYGDAG

SEQ ID NO: 1353 - protein, 10 aa, Artificial Sequence
  Description of Artificial Sequence: Synthetic 208A VH CDR2 according to AbM
VIDTYYGDAG

SEQ ID NO: 1354 - protein, 17 aa, Artificial Sequence
  Description of Artificial Sequence: Synthetic 215A VH CDR2 exemplary sequence
LISPYNGGTSYNQKFKG

SEQ ID NO: 1355 - protein, 8 aa, Artificial Sequence
  Description of Artificial Sequence: Synthetic 215A VH CDR2 according to IMGT
ISPYNGGT

SEQ ID NO: 1356 - protein, 4 aa, Artificial Sequence
  Description of Artificial Sequence: Synthetic 215A VH CDR2 according to Chothia
PYNG

SEQ ID NO: 1357 - protein, 13 aa, Artificial Sequence
  Description of Artificial Sequence: Synthetic 215A VH CDR2 according to Contact
WIGLISPYNGGTS

SEQ ID NO: 1358 - protein, 10 aa, Artificial Sequence
  Description of Artificial Sequence: Synthetic 215A VH CDR2 according to AbM
LISPYNGGTS

SEQ ID NO: 1359 - protein, 17 aa, Artificial Sequence
  Description of Artificial Sequence: Synthetic 164A VH CDR2 exemplary sequence
NIDPYYGSASYNQKFKG

SEQ ID NO: 1360 - protein, 8 aa, Artificial Sequence
  Description of Artificial Sequence: Synthetic 164A VH CDR2 according to IMGT
IDPYYGSA

SEQ ID NO: 1361 - protein, 4 aa, Artificial Sequence
  Description of Artificial Sequence: Synthetic 164A VH CDR2 according to Chothia
PYYG

SEQ ID NO: 1362 - protein, 13 aa, Artificial Sequence
  Description of Artificial Sequence: Synthetic 164A VH CDR2 according to Contact
WIGNIDPYYGSAS

SEQ ID NO: 1363 - protein, 10 aa, Artificial Sequence
  Description of Artificial Sequence: Synthetic 164A VH CDR2 according to AbM
NIDPYYGSAS

SEQ ID NO: 1364 - protein, 17 aa, Artificial Sequence
  Description of Artificial Sequence: Synthetic 230A VH CDR2 exemplary sequence
NIDPYYGYTTYNQKFKG

SEQ ID NO: 1365 - protein, 8 aa, Artificial Sequence
  Description of Artificial Sequence: Synthetic 230A VH CDR2 according to IMGT
IDPYYGYT

SEQ ID NO: 1366 - protein, 13 aa, Artificial Sequence
  Description of Artificial Sequence: Synthetic 230A VH CDR2 according to Contact
WIGNIDPYYGYTT

SEQ ID NO: 1367 - protein, 10 aa, Artificial Sequence
  Description of Artificial Sequence: Synthetic 230A VH CDR2 according to AbM
NIDPYYGYTT

SEQ ID NO: 1368 - protein, 17 aa, Artificial Sequence
  Description of Artificial Sequence: Synthetic 53A VH CDR2 exemplary sequence
YIYPYNDGTKYNEKFKG

SEQ ID NO: 1369 - protein, 8 aa, Artificial Sequence
  Description of Artificial Sequence: Synthetic 53A VH CDR2 according to IMGT
IYPYNDGT

SEQ ID NO: 1370 - protein, 4 aa, Artificial Sequence
  Description of Artificial Sequence: Synthetic 53A VH CDR2 according to Chothia
PYND

SEQ ID NO: 1371 - protein, 13 aa, Artificial Sequence
  Description of Artificial Sequence: Synthetic 53A VH CDR2 according to Contact
WIGYIYPYNDGTK

SEQ ID NO: 1372 - protein, 10 aa, Artificial Sequence
  Description of Artificial Sequence: Synthetic 53A VH CDR2 according to AbM
YIYPYNDGTK

SEQ ID NO: 1373 - protein, 13 aa, Artificial Sequence
  Description of Artificial Sequence: Synthetic 321D VH CDR2 according to Contact
WIGEILPGSGSTD

SEQ ID NO: 1374 - protein, 10 aa, Artificial Sequence
  Description of Artificial Sequence: Synthetic 321D VH CDR2 according to AbM
EILPGSGSTD

SEQ ID NO: 1375 - protein, 17 aa, Artificial Sequence
  Description of Artificial Sequence: Synthetic 353A VH CDR2 exmemplary sequence
EINPDSSTINYTPSLKD

SEQ ID NO: 1376 - protein, 8 aa, Artificial Sequence
  Description of Artificial Sequence: Synthetic 353A VH CDR2 according to IMGT
INPDSSTI

SEQ ID NO: 1377 - protein, 4 aa, Artificial Sequence
  Description of Artificial Sequence: Synthetic 353A VH CDR2 according to Chothia
PDSS

SEQ ID NO: 1378 - protein, 13 aa, Artificial Sequence
  Description of Artificial Sequence: Synthetic 353A VH CDR2 according to Contact
WIGEINPDSSTIN

SEQ ID NO: 1379 - protein, 10 aa, Artificial Sequence
  Description of Artificial Sequence: Synthetic 353A VH CDR2 according to AbM
EINPDSSTIN

SEQ ID NO: 1380 - protein, 16 aa, Artificial Sequence
  Description of Artificial Sequence: Synthetic 305A VH CDR2 exemplary sequence
YISYDGSNNYNPSLKN

SEQ ID NO: 1381 - protein, 7 aa, Artificial Sequence
  Description of Artificial Sequence: Synthetic 305A VH CDR2 according to IMGT
ISYDGSN

SEQ ID NO: 1382 - protein, 3 aa, Artificial Sequence
  Description of Artificial Sequence: Synthetic 305A VH CDR2 according to Chothia
YDG

SEQ ID NO: 1383 - protein, 12 aa, Artificial Sequence
  Description of Artificial Sequence: Synthetic 305A VH CDR2 according to Contact
WMGYISYDGSNN

SEQ ID NO: 1384 - protein, 9 aa, Artificial Sequence
  Description of Artificial Sequence: Synthetic 305A VH CDR2 according to AbM
YISYDGSNN

SEQ ID NO: 1385 - protein, 8 aa, Artificial Sequence
  Description of Artificial Sequence: Synthetic h128A VH CDR3
RAGNAMDY

SEQ ID NO: 1386 - protein, 10 aa, Artificial Sequence
  Description of Artificial Sequence: Synthetic 5B VH CDR3 according to IMGT
ARRAGNAMDY

SEQ ID NO: 1387 - protein, 6 aa, Artificial Sequence
  Description of Artificial Sequence: Synthetic 5B VH CDR3 according to Chothia
AGNAMD

SEQ ID NO: 1388 - protein, 9 aa, Artificial Sequence
  Description of Artificial Sequence: Synthetic 5B VH CDR3 according to Contact
ARRAGNAMD

SEQ ID NO: 1389 - protein, 8 aa, Artificial Sequence
  Description of Artificial Sequence: Synthetic 46A VH CDR3 exemplary sequence
RAGTAMDY

SEQ ID NO: 1390 - protein, 10 aa, Artificial Sequence
  Description of Artificial Sequence: Synthetic 46A VH CDR3 according to IMGT
ARRAGTAMDY

SEQ ID NO: 1391 - protein, 6 aa, Artificial Sequence
  Description of Artificial Sequence: Synthetic 46A VH CDR3 according to Chothia
AGTAMD

SEQ ID NO: 1392 - protein, 9 aa, Artificial Sequence
  Description of Artificial Sequence: Synthetic 46A VH CDR3 according to Contact
ARRAGTAMD

SEQ ID NO: 1393 - protein, 9 aa, Artificial Sequence
  Description of Artificial Sequence: Synthetic 215A VH CDR3 exemplary sequence
RAYGYAMDY

SEQ ID NO: 1394 - protein, 11 aa, Artificial Sequence
  Description of Artificial Sequence: Synthetic 215A VH CDR3 according to IMGT
ARRAYGYAMDY

SEQ ID NO: 1395 - protein, 7 aa, Artificial Sequence
  Description of Artificial Sequence: Synthetic 215A VH CDR3 according to Chothia
AYGYAMD

SEQ ID NO: 1396 - protein, 10 aa, Artificial Sequence
  Description of Artificial Sequence: Synthetic 215A VH CDR3 according to Contact
ARRAYGYAMD

SEQ ID NO: 1397 - protein, 11 aa, Artificial Sequence
  Description of Artificial Sequence: Synthetic 164A VH CDR3 exemplary sequence
SNYGYYGYFDV

SEQ ID NO: 1398 - protein, 13 aa, Artificial Sequence
  Description of Artificial Sequence: Synthetic 164A VH CDR3 according to IMGT
TRSNYGYYGYFDV

SEQ ID NO: 1399 - protein, 9 aa, Artificial Sequence
  Description of Artificial Sequence: Synthetic 164A VH CDR3 according to Chothia
NYGYYGYFD

SEQ ID NO: 1400 - protein, 12 aa, Artificial Sequence
  Description of Artificial Sequence: Synthetic 164A VH CDR3 according to Contact
TRSNYGYYGYFD

SEQ ID NO: 1401 - protein, 11 aa, Artificial Sequence
  Description of Artificial Sequence: Synthetic 230A VH CDR3 exemplary sequence
DYDYALGYFDV

SEQ ID NO: 1402 - protein, 13 aa, Artificial Sequence
  Description of Artificial Sequence: Synthetic 230A VH CDR3 according to IMGT
ARDYDYALGYFDV

SEQ ID NO: 1403 - protein, 9 aa, Artificial Sequence
  Description of Artificial Sequence: Synthetic 230A VH CDR3 according to Chothia
YDYALGYFD

SEQ ID NO: 1404 - protein, 12 aa, Artificial Sequence
  Description of Artificial Sequence: Synthetic 230A VH CDR3 according to Contact
ARDYDYALGYFD

SEQ ID NO: 1405 - protein, 8 aa, Artificial Sequence
  Description of Artificial Sequence: Synthetic peptide
FDYDTLRY

SEQ ID NO: 1406 - protein, 10 aa, Artificial Sequence
  Description of Artificial Sequence: Synthetic 53A VH CDR3 exemplary sequence
ARFDYDTLRY

SEQ ID NO: 1407 - protein, 6 aa, Artificial Sequence
  Description of Artificial Sequence: Synthetic 53A VH CDR3 according to IMGT
DYDTLR

SEQ ID NO: 1408 - protein, 9 aa, Artificial Sequence
  Description of Artificial Sequence: Synthetic 53A VH CDR3 according to Chothia
ARFDYDTLR

SEQ ID NO: 1409 - protein, 10 aa, Artificial Sequence
  Description of Artificial Sequence: Synthetic 53A VH CDR3 according to Contact
WLLYYYAMVY

SEQ ID NO: 1410 - protein, 12 aa, Artificial Sequence
  Description of Artificial Sequence: Synthetic 33A VH CDR3 according to IMGT
ARWLLYYYAMVY

SEQ ID NO: 1411 - protein, 8 aa, Artificial Sequence
  Description of Artificial Sequence: Synthetic 33A VH CDR3 according to Chothia
LLYYYAMV

SEQ ID NO: 1412 - protein, 11 aa, Artificial Sequence
  Description of Artificial Sequence: Synthetic 33A VH CDR3 according to Contact
ARWLLYYYAMV

SEQ ID NO: 1413 - protein, 10 aa, Artificial Sequence
  Description of Artificial Sequence: Synthetic 124A VH CDR3 exemplary sequence
WLLYYYAMDF

SEQ ID NO: 1414 - protein, 12 aa, Artificial Sequence
  Description of Artificial Sequence: Synthetic 124A VH CDR3 according to IMGT
ARWLLYYYAMDF

SEQ ID NO: 1415 - protein, 14 aa, Artificial Sequence
  Description of Artificial Sequence: Synthetic 51A VH CDR3 according to IMGT
ASEEVYDGYPWFGY

SEQ ID NO: 1416 - protein, 13 aa, Artificial Sequence
  Description of Artificial Sequence: Synthetic 51A VH CDR3 according to Contact
ASEEVYDGYPWFG

SEQ ID NO: 1417 - protein, 14 aa, Artificial Sequence
  Description of Artificial Sequence: Synthetic 353A VH CDR3 exemplary sequence
PGEIYYYGSYWFAY

SEQ ID NO: 1418 - protein, 16 aa, Artificial Sequence
  Description of Artificial Sequence: Synthetic 353A VH CDR3 according to IMGT
ARPGEIYYYGSYWFAY

SEQ ID NO: 1419 - protein, 12 aa, Artificial Sequence
  Description of Artificial Sequence: Synthetic 353A VH CDR3 according to Chothia
GEIYYYGSYWFA

SEQ ID NO: 1420 - protein, 15 aa, Artificial Sequence
  Description of Artificial Sequence: Synthetic 353A VH CDR3 according to Contact
ARPGEIYYYGSYWFA

SEQ ID NO: 1421 - protein, 9 aa, Artificial Sequence
  Description of Artificial Sequence: Synthetic 305A VH CDR3 exemplary sequence
RHDYLSFAY

SEQ ID NO: 1422 - protein, 11 aa, Artificial Sequence
  Description of Artificial Sequence: Synthetic 305A VH CDR3 according to IMGT
ARRHDYLSFAY

SEQ ID NO: 1423 - protein, 7 aa, Artificial Sequence
  Description of Artificial Sequence: Synthetic 305A VH CDR3 according to Chothia
HDYLSFA

SEQ ID NO: 1424 - protein, 10 aa, Artificial Sequence
  Description of Artificial Sequence: Synthetic 305A VH CDR3 according to Contact
ARRHDYLSFA

SEQ ID NO: 1425 - protein, 11 aa, Artificial Sequence
  Description of Artificial Sequence: Synthetic 5B VL CDR1 exemplary sequence
KASQSVSNDVA

SEQ ID NO: 1426 - protein, 6 aa, Artificial Sequence
  Description of Artificial Sequence: Synthetic 5B VL CDR1 according to IMGT
QSVSND

SEQ ID NO: 1427 - protein, 7 aa, Artificial Sequence
  Description of Artificial Sequence: Synthetic 5B VL CDR1 according to Chothia
SQSVSND

SEQ ID NO: 1428 - protein, 7 aa, Artificial Sequence
  Description of Artificial Sequence: Synthetic 5B VL CDR1 according to Contact
SNDVAWY

SEQ ID NO: 1429 - protein, 11 aa, Artificial Sequence
  Description of Artificial Sequence: Synthetic 128A VL CDR1 exemplary sequence
KASQSVSNDIA

SEQ ID NO: 1430 - protein, 7 aa, Artificial Sequence
  Description of Artificial Sequence: Synthetic 128A VL CDR1 according to Contact
SNDIAWY

SEQ ID NO: 1431 - protein, 10 aa, Artificial Sequence
  Description of Artificial Sequence: Synthetic 215A VL CDR1 exemplary sequence
SASSSVSYMF

SEQ ID NO: 1432 - protein, 5 aa, Artificial Sequence
  Description of Artificial Sequence: Synthetic 215A VL CDR1 according to IMGT
SSVSY

SEQ ID NO: 1433 - protein, 6 aa, Artificial Sequence
  Description of Artificial Sequence: Synthetic 215A VL CDR1 according to Chothia
SSSVSY

SEQ ID NO: 1434 - protein, 6 aa, Artificial Sequence
  Description of Artificial Sequence: Synthetic 215A VL CDR1 according to Contact
SYMFWY

SEQ ID NO: 1435 - protein, 10 aa, Artificial Sequence
  Description of Artificial Sequence: Synthetic 26A VL CDR1 exemplary sequence
SASSSVSYMY

SEQ ID NO: 1436 - protein, 6 aa, Artificial Sequence
  Description of Artificial Sequence: Synthetic 26A VL CDR1 according to Contact
SYMYWY

SEQ ID NO: 1437 - protein, 17 aa, Artificial Sequence
  Description of Artificial Sequence: Synthetic 164A VL CDR1 exemplary sequence
KSSQSVLYSSNQKNYLA

SEQ ID NO: 1438 - protein, 12 aa, Artificial Sequence
  Description of Artificial Sequence: Synthetic 164A VL CDR1 according to IMGT
QSVLYSSNQKNY

SEQ ID NO: 1439 - protein, 13 aa, Artificial Sequence
  Description of Artificial Sequence: Synthetic 164A VL CDR1 according to Chothia
SQSVLYSSNQKNY

SEQ ID NO: 1440 - protein, 17 aa, Artificial Sequence
  Description of Artificial Sequence: Synthetic consensus CDRs of VH by paratope group (Fig. 18)
  MOD_RES (1)..(1): Ile, Val or Leu
  MOD_RES (3)..(3): Asn or Asp
  MOD_RES (10)..(10): Thr, Ser or Gly
  MOD_RES (11)..(11): Tyr or Asn
  MOD_RES (13)..(13): Gln or His
XIXTYYGDAXXNXKFKG

SEQ ID NO: 1441 - protein, 10 aa, Artificial Sequence
  Description of Artificial Sequence: Synthetic consensus CDRs of VH by paratope group (Fig. 18)
  MOD_RES (6)..(6): Ser or Thr
  MOD_RES (7)..(7): Tyr, Asn or His
GYTFSXXWIE

SEQ ID NO: 1442 - protein, 17 aa, Artificial Sequence
  Description of Artificial Sequence: Synthetic consensus CDRs of VH by paratope group (Fig. 18)
  MOD_RES (10)..(10): Ser or Asp
EILPGSGSTXYNEKFKG

SEQ ID NO: 1443 - protein, 11 aa, Artificial Sequence
  Description of Artificial Sequence: Synthetic Consensus CDRs of VH by paratope group (Fig. 18)
  MOD_RES (10)..(10): Val or Ile
KASQSVSNDXA

SEQ ID NO: 1444 - protein, 9 aa, Artificial Sequence
  Description of Artificial Sequence: Synthetic Consensus CDRs of VH by paratope group (Fig. 18)
  MOD_RES (5)..(5): Ser or Gly
QQDYXSPRT

SEQ ID NO: 1445 - protein, 7 aa, Artificial Sequence
  Description of Artificial Sequence: Synthetic Consensus CDRs of VH by paratope group (Fig. 18)
  MOD_RES (2)..(2): Val or Ile
LXSNRFS

SEQ ID NO: 1446 - protein, 16 aa, Artificial Sequence
  Description of Artificial Sequence: Synthetic Consensus CDRs of VH by paratope group (Fig. 18)
  MOD_RES (9)..(9): Ser or Asn
RSSQSIVHXNGNTYLE

SEQ ID NO: 1447 - protein, 7 aa, Artificial Sequence
  Description of Artificial Sequence: Synthetic Consensus CDRs of VH by paratope group (Fig. 18)
  MOD_RES (2)..(2): Val or Leu
KXSNRFS

SEQ ID NO: 1448 - protein, 9 aa, Artificial Sequence
  Description of Artificial Sequence: Synthetic Consensus CDRs of VH by paratope group (Fig. 18)
  MOD_RES (6)..(6): Val or Phe
FQGSHXPFT

SEQ ID NO: 1449 - protein, 10 aa, Artificial Sequence
  Description of Artificial Sequence: Synthetic Consensus CDRs of VH by paratope group (Fig. 18)
WLLYYYAMDY

SEQ ID NO: 1450 - protein, 13 aa, Artificial Sequence
  Description of Artificial Sequence: Synthetic 164A VL CDR1 #1 according to Contact
LYSSNQKNYLAWY

SEQ ID NO: 1451 - protein, 12 aa, Artificial Sequence
  Description of Artificial Sequence: Synthetic 164A VL CDR1 #2 exemplary sequence
SASSSVSSSNLH

SEQ ID NO: 1452 - protein, 7 aa, Artificial Sequence
  Description of Artificial Sequence: Synthetic 164A VL CDR1 #2 according to IMGT
SSVSSSN

SEQ ID NO: 1453 - protein, 8 aa, Artificial Sequence
  Description of Artificial Sequence: Synthetic 164A VL CDR1 #2 according to Chothia
SSSVSSSN

SEQ ID NO: 1454 - protein, 16 aa, Artificial Sequence
  Description of Artificial Sequence: Synthetic 230A VL CDR1 exemplary sequence
RSSQSLVHSNGNTYLH

SEQ ID NO: 1455 - protein, 11 aa, Artificial Sequence
  Description of Artificial Sequence: Synthetic 230A VL CDR1 according to IMGT
QSLVHSNGNTY

SEQ ID NO: 1456 - protein, 12 aa, Artificial Sequence
  Description of Artificial Sequence: Synthetic 230A VL CDR1 according to Chothia
SQSLVHSNGNTY

SEQ ID NO: 1457 - protein, 12 aa, Artificial Sequence
  Description of Artificial Sequence: Synthetic 230A VL CDR1 according to Contact
VHSNGNTYLHWY

SEQ ID NO: 1458 - protein, 16 aa, Artificial Sequence
  Description of Artificial Sequence: Synthetic 53A VL CDR1 according to Kabat
KSTKSLLNSDGFTYLD

SEQ ID NO: 1459 - protein, 11 aa, Artificial Sequence
  Description of Artificial Sequence: Synthetic 53A VL CDR1 according to IMGT
KSLLNSDGFTY

SEQ ID NO: 1460 - protein, 12 aa, Artificial Sequence
  Description of Artificial Sequence: Synthetic 53A VL CDR1 according to Chothia
TKSLLNSDGFTY

SEQ ID NO: 1461 - protein, 12 aa, Artificial Sequence
  Description of Artificial Sequence: Synthetic 53A VL CDR1 according to Contact
LNSDGFTYLDWY

SEQ ID NO: 1462 - protein, 16 aa, Artificial Sequence
  Description of Artificial Sequence: Synthetic 39A VL CDR1 exemplary sequence
RSSQSIVHNNGNTYLE

SEQ ID NO: 1463 - protein, 11 aa, Artificial Sequence
  Description of Artificial Sequence: Synthetic 39A VL CDR1 according to IMGT
QSIVHNNGNTY

SEQ ID NO: 1464 - protein, 12 aa, Artificial Sequence
  Description of Artificial Sequence: Synthetic 39A VL CDR1 according to Chothia
SQSIVHNNGNTY

SEQ ID NO: 1465 - protein, 12 aa, Artificial Sequence
  Description of Artificial Sequence: Synthetic 39A VL CDR1 according to Contact
VHNNGNTYLEWY

SEQ ID NO: 1466 - protein, 15 aa, Artificial Sequence
  Description of Artificial Sequence: Synthetic 353A VL CDR1 exemplary sequence
RASESVEYYGTSLMQ

SEQ ID NO: 1467 - protein, 10 aa, Artificial Sequence
  Description of Artificial Sequence: Synthetic 353A VL CDR1 according to IMGT
ESVEYYGTSL

SEQ ID NO: 1468 - protein, 11 aa, Artificial Sequence
  Description of Artificial Sequence: Synthetic 353A VL CDR1 according to Chothia
SESVEYYGTSL

SEQ ID NO: 1469 - protein, 15 aa, Artificial Sequence
  Description of Artificial Sequence: Synthetic 353A VL CDR1 according to IMGT
KASQSVDYDGDSYMN

SEQ ID NO: 1470 - protein, 10 aa, Artificial Sequence
  Description of Artificial Sequence: Synthetic 305A VL CDR1 exemplary sequence
QSVDYDGDSY

SEQ ID NO: 1471 - protein, 11 aa, Artificial Sequence
  Description of Artificial Sequence: Synthetic 305A VL CDR1 according to Chothia
SQSVDYDGDSY

SEQ ID NO: 1472 - protein, 11 aa, Artificial Sequence
  Description of Artificial Sequence: Synthetic 305A VL CDR1 according to Contact
DYDGDSYMNWY

SEQ ID NO: 1473 - protein, 7 aa, Artificial Sequence
  Description of Artificial Sequence: Synthetic 5B VL CDR2 exemplary sequence
YASNRYT

SEQ ID NO: 1474 - protein, 3 aa, Artificial Sequence
  Description of Artificial Sequence: Synthetic 5B VL CDR2 according to IMGT
YAS

SEQ ID NO: 1475 - protein, 10 aa, Artificial Sequence
  Description of Artificial Sequence: Synthetic 5B VL CDR2 according to Contact
LLIYYASNRY

SEQ ID NO: 1476 - protein, 7 aa, Artificial Sequence
  Description of Artificial Sequence: Synthetic 215A VL CDR2 exemplary sequence
DTSNLAS

SEQ ID NO: 1477 - protein, 3 aa, Artificial Sequence
  Description of Artificial Sequence: Synthetic 215A VL CDR2 according to IMGT
DTS

SEQ ID NO: 1478 - protein, 10 aa, Artificial Sequence
  Description of Artificial Sequence: Synthetic 215A VL CDR2 according to Contact
LLIYDTSNLA

SEQ ID NO: 1479 - protein, 7 aa, Artificial Sequence
  Description of Artificial Sequence: Synthetic 164A VL CDR2 #2 exmeplary sequence
RTSNLAS

SEQ ID NO: 1480 - protein, 3 aa, Artificial Sequence
  Description of Artificial Sequence: Synthetic 164A VL CDR2 #2 according to IMGT
RTS

SEQ ID NO: 1481 - protein, 10 aa, Artificial Sequence
  Description of Artificial Sequence: Synthetic 164A VL CDR2 #2 according to Contact
FWIYRTSNLA

SEQ ID NO: 1482 - protein, 7 aa, Artificial Sequence
  Description of Artificial Sequence: Synthetic 53A VL CDR2 exemplary sequence
LVSNRFS

SEQ ID NO: 1483 - protein, 3 aa, Artificial Sequence
  Description of Artificial Sequence: Synthetic 53A VL CDR2 according to IMGT
LVS

SEQ ID NO: 1484 - protein, 10 aa, Artificial Sequence
  Description of Artificial Sequence: Synthetic 53A VL CDR2 according to Contact
LLIYLVSNRF

SEQ ID NO: 1485 - protein, 7 aa, Artificial Sequence
  Description of Artificial Sequence: Synthetic 259A VL CDR2 exemplary sequence
LISNRFS

SEQ ID NO: 1486 - protein, 3 aa, Artificial Sequence
  Description of Artificial Sequence: Synthetic 259A VL CDR2 according to IMGT
LIS

SEQ ID NO: 1487 - protein, 10 aa, Artificial Sequence
  Description of Artificial Sequence: Synthetic 259A VL CDR2 according to Contact
LLIYLISNRF

SEQ ID NO: 1488 - protein, 7 aa, Artificial Sequence
  Description of Artificial Sequence: Synthetic 353A VL CDR2 exemplary sequence
AASNVES

SEQ ID NO: 1489 - protein, 3 aa, Artificial Sequence
  Description of Artificial Sequence: Synthetic 353A VL CDR2 according to IMGT
AAS

SEQ ID NO: 1490 - protein, 10 aa, Artificial Sequence
  Description of Artificial Sequence: Synthetic 353A VL CDR2 according to Contact
LLIYAASNVE

SEQ ID NO: 1491 - protein, 7 aa, Artificial Sequence
  Description of Artificial Sequence: Synthetic 305A VL CDR2 exemplary sequence
AASNLES

SEQ ID NO: 1492 - protein, 10 aa, Artificial Sequence
  Description of Artificial Sequence: Synthetic 305A VL CDR2 according to Contact
LLIYAASNLE

SEQ ID NO: 1493 - protein, 9 aa, Artificial Sequence
  Description of Artificial Sequence: Synthetic h128A VL CDR3
QQDYSSPRT

SEQ ID NO: 1494 - protein, 6 aa, Artificial Sequence
  Description of Artificial Sequence: Synthetic 5B VL CDR3 according to Chothia
DYSSPR

SEQ ID NO: 1495 - protein, 8 aa, Artificial Sequence
  Description of Artificial Sequence: Synthetic 5B VL CDR3 according to Contact
QQDYSSPR

SEQ ID NO: 1496 - protein, 9 aa, Artificial Sequence
  Description of Artificial Sequence: Synthetic 46A VL CDR3 according to Kabat
QQDYGSPRT

SEQ ID NO: 1497 - protein, 6 aa, Artificial Sequence
  Description of Artificial Sequence: Synthetic 46A VL CDR3 according to Chothia
DYGSPR

SEQ ID NO: 1498 - protein, 8 aa, Artificial Sequence
  Description of Artificial Sequence: Synthetic 46A VL CDR3 according to Contact
QQDYGSPR

SEQ ID NO: 1499 - protein, 9 aa, Artificial Sequence
  Description of Artificial Sequence: Synthetic 215A VL CDR3 according to Kabat
QQWSSYPFT

SEQ ID NO: 1500 - protein, 6 aa, Artificial Sequence
  Description of Artificial Sequence: Synthetic 215A VL CDR3 according to Chothia
WSSYPF

SEQ ID NO: 1501 - protein, 8 aa, Artificial Sequence
  Description of Artificial Sequence: Synthetic 215A VL CDR3 according to Contact
QQWSSYPF

SEQ ID NO: 1502 - protein, 9 aa, Artificial Sequence
  Description of Artificial Sequence: Synthetic 164A VL CDR3 #2 according to Kabat
QQWSGYPRT

SEQ ID NO: 1503 - protein, 6 aa, Artificial Sequence
  Description of Artificial Sequence: Synthetic 164A VL CDR3 #2 according to Chothia
WSGYPR

SEQ ID NO: 1504 - protein, 8 aa, Artificial Sequence
  Description of Artificial Sequence: Synthetic 164A VL CDR3 #2 according to Contact
QQWSGYPR

SEQ ID NO: 1505 - protein, 9 aa, Artificial Sequence
  Description of Artificial Sequence: Synthetic 230A VL CDR3 according to Kabat
SQSTHVPYT

SEQ ID NO: 1506 - protein, 6 aa, Artificial Sequence
  Description of Artificial Sequence: Synthetic 230A VL CDR3 according to Chothia
STHVPY

SEQ ID NO: 1507 - protein, 8 aa, Artificial Sequence
  Description of Artificial Sequence: Synthetic 230A VL CDR3 according to Contact
SQSTHVPY

SEQ ID NO: 1508 - protein, 9 aa, Artificial Sequence
  Description of Artificial Sequence: Synthetic 53A VL CDR3 according to Kabat
FQSNYFPWT

SEQ ID NO: 1509 - protein, 6 aa, Artificial Sequence
  Description of Artificial Sequence: Synthetic 53A VL CDR3 according to Chothia
SNYFPW

SEQ ID NO: 1510 - protein, 8 aa, Artificial Sequence
  Description of Artificial Sequence: Synthetic 53A VL CDR3 according to Contact
FQSNYFPW

SEQ ID NO: 1511 - protein, 9 aa, Artificial Sequence
  Description of Artificial Sequence: Synthetic 33A VL CDR3 according to Kabat
FQGSHVPYT

SEQ ID NO: 1512 - protein, 6 aa, Artificial Sequence
  Description of Artificial Sequence: Synthetic 33A VL CDR3 according to Chothia
GSHVPY

SEQ ID NO: 1513 - protein, 8 aa, Artificial Sequence
  Description of Artificial Sequence: Synthetic 33A VL CDR3 according to Contact
FQGSHVPY

SEQ ID NO: 1514 - protein, 9 aa, Artificial Sequence
  Description of Artificial Sequence: Synthetic 321D VL CDR3 according to Kabat
FQGSHVPFT

SEQ ID NO: 1515 - protein, 6 aa, Artificial Sequence
  Description of Artificial Sequence: Synthetic 321D VL CDR3 according to Chothia
GSHVPF

SEQ ID NO: 1516 - protein, 8 aa, Artificial Sequence
  Description of Artificial Sequence: Synthetic 321D VL CDR3 according to Contact
FQGSHVPF

SEQ ID NO: 1517 - protein, 9 aa, Artificial Sequence
  Description of Artificial Sequence: Synthetic 353A VL CDR3 according to Kabat
QQSRKDPWT

SEQ ID NO: 1518 - protein, 6 aa, Artificial Sequence
  Description of Artificial Sequence: Synthetic 353A VL CDR3 according to Chothia
SRKDPW

SEQ ID NO: 1519 - protein, 8 aa, Artificial Sequence
  Description of Artificial Sequence: Synthetic 353A VL CDR3 according to Contact
QQSRKDPW

SEQ ID NO: 1520 - protein, 9 aa, Artificial Sequence
  Description of Artificial Sequence: Synthetic 305A VL CDR3 according to Kabat
QQSDEDPYT

SEQ ID NO: 1521 - protein, 6 aa, Artificial Sequence
  Description of Artificial Sequence: Synthetic 305A VL CDR3 according to Chothia
SDEDPY

SEQ ID NO: 1522 - protein, 8 aa, Artificial Sequence
  Description of Artificial Sequence: Synthetic 305A VL CDR3 according to Contact
QQSDEDPY

SEQ ID NO: 1523 - protein, 8 aa, Artificial Sequence
  Description of Artificial Sequence: Synthetic 164A VL CDR3 according to Kabat
HQFLSSYT

SEQ ID NO: 1524 - protein, 5 aa, Artificial Sequence
  Description of Artificial Sequence: Synthetic 164A VL CDR3 according to Chothia
FLSSY

SEQ ID NO: 1525 - protein, 7 aa, Artificial Sequence
  Description of Artificial Sequence: Synthetic 164A VL CDR3 according to Contact
HQFLSSY

SEQ ID NO: 1526 - protein, 7 aa, Artificial Sequence
  Description of Artificial Sequence: Synthetic 164A VL CDR2 according to Kabat
WASTRES

SEQ ID NO: 1527 - protein, 3 aa, Artificial Sequence
  Description of Artificial Sequence: Synthetic 164A VL CDR2 according to IMGT
WAS

SEQ ID NO: 1528 - protein, 10 aa, Artificial Sequence
  Description of Artificial Sequence: Synthetic 164A VL CDR2 according to Contact
LLIYWASTRE

SEQ ID NO: 1529 - protein, 118 aa, Artificial Sequence
  Description of Artificial Sequence: Synthetic humanized VH domain of 26A
QVQLVQSGAEVKKPGASVKVSCKASGFSFTGYTMNWVRQAPGQGLEWMGLISPYNGGTSYAQKFQGRVTMTRDTSTSTVYMELSSLRSEDTAVYYCARRAYGYAMDYWGQGTLVTVSS

SEQ ID NO: 1530 - protein, 118 aa, Artificial Sequence
  Description of Artificial Sequence: Synthetic humanized VH domain of 26A
QVQLVQSGAEVKKPGASVKISCKASGFSFTGYTMNWVRQAPGQGLEWIGLISPYNGGTSYAQKFQGRATLTVDTSTSTAYMELSSLRSEDTAVYYCARRAYGYAMDYWGQGTLVTVSS

SEQ ID NO: 1531 - protein, 118 aa, Artificial Sequence
  Description of Artificial Sequence: Synthetic humanized VH domain of 26A
QVQLVQSGAEVKKPGASVKISCKASGFSFTGYTMNWVRQAPGQGLEWIGLISPYNGGTSYAQKFQGRATLTVDKSTSTAYMELSSLRSEDTAVYYCARRAYGYAMDYWGQGTLVTVSS

SEQ ID NO: 1532 - protein, 106 aa, Artificial Sequence
  Description of Artificial Sequence: Synthetic humanized VL domain of 26A
EIVLTQSPATLSLSPGERATLSCSASSSVSYMYWYQQKPGQAPRLLIYDTSNLASGIPARFSGSGSGTDFTLTISSLEPEDFAVYYCQQWSSYPFTFGQGTKLEIK

SEQ ID NO: 1533 - protein, 106 aa, Artificial Sequence
  Description of Artificial Sequence: Synthetic humanized VL domain of 26A
EIVLTQSPATLSLSPGERVTMSCSASSSVSYMYWYQQKPGQAPRLLIYDTSNLASGVPARFSGSGSGTDYTLTISSMEPEDFAVYYCQQWSSYPFTFGQGTKLEIK

SEQ ID NO: 1534 - protein, 106 aa, Artificial Sequence
  Description of Artificial Sequence: Synthetic humanized VL domain of 26A
EIVLTQSPATMSASPGERVTMSCSASSSVSYMYWYQQKPGQAPRLLIYDTSNLASGVPARFSGSGSGTDYTLTISSMEPEDFAVYYCQQWSSYPFTFGQGTKLEIK

SEQ ID NO: 1535 - protein, 117 aa, Artificial Sequence
  Description of Artificial Sequence: Synthetic humanized VH domain of 128A
QVQLVQSGAEVKKPGASVKVSCKASGYTFTDYGMHWVRQAPGQGLEWMGLIDTYYGDATYAQKFQGRVTMTRDTSTSTVYMELSSLRSEDTAVYYCARRAGNAMDYWGQGTLVTVSS

SEQ ID NO: 1536 - protein, 117 aa, Artificial Sequence
  Description of Artificial Sequence: Synthetic humanized VH domain of 128A
QVQLVQSGAEVKKPGASVKISCKGSGYTFTDYGMHWVRQAPGQGLEWIGLIDTYYGDATYAQKFQGRATMTVDTSTSTAYMELSSLRSEDTAVYYCARRAGNAMDYWGQGTLVTVSS

SEQ ID NO: 1537 - protein, 117 aa, Artificial Sequence
  Description of Artificial Sequence: Synthetic humanized VH domain of 128A
QVQLVQSGAEVKKPGASVKISCKGSGYTFTDYGMHWVRQAPGQGLEWIGLIDTYYGDATYAQKFQGRATMTVDKSTSTAYMELSSLRSEDTAVYYCARRAGNAMDYWGQGTLVTVSS

SEQ ID NO: 1538 - protein, 107 aa, Artificial Sequence
  Description of Artificial Sequence: Synthetic humanized VL domain of 128A
DIQMTQSPSSLSASVGDRVTITCKASQSVSNDIAWYQQKPGKAPKLLIYYASNRYTGVPSRFSGSGSGTDFTLTISSLQPEDFATYYCQQDYSSPRTFGQGTKLEIK

SEQ ID NO: 1539 - protein, 107 aa, Artificial Sequence
  Description of Artificial Sequence: Synthetic humanized VL domain of 128A
DIQMTQSPSSLSVSVGDRVTITCKASQSVSNDIAWYQQKPGKAPKLLIYYASNRYTGVPSRFSGSGSGTDFTFTISSVQPEDFATYYCQQDYSSPRTFGQGTKLEIK

SEQ ID NO: 1540 - protein, 107 aa, Artificial Sequence
  Description of Artificial Sequence: Synthetic humanized VL domain of 128A
DIQMTQSPSSLSVSVGDRVTITCKASQSVSNDIAWYQQKPGKAPKLLIYYASNRYTGVPSRFSGSGYGTDFTFTISSVQPEDFATYYCQQDYSSPRTFGQGTKLEIK

SEQ ID NO: 1541 - protein, 119 aa, Artificial Sequence
  Description of Artificial Sequence: Synthetic humanized VH domain of 124A
QVQLVQSGAEVKKPGASVKVSCKASGYTFSSNWIEWVRQAPGQGLEWMGEILPGSGSTSYAQKFQGRVTMTRDTSTSTVYMELSSLRSEDTAVYYCARWLLYYYAMDFWGQGTLVTVSS

SEQ ID NO: 1542 - protein, 119 aa, Artificial Sequence
  Description of Artificial Sequence: Synthetic humanized VH domain of 124A
QVQLVQSGAEVKKPGASVKISCKASGYTFSSNWIEWVRQAPGQGLEWMGEILPGSGSTSYAQKFQGRATFTADTSTSTAYMELSSLRSEDTAVYYCARWLLYYYAMDFWGQGTLVTVSS

SEQ ID NO: 1543 - protein, 117 aa, Artificial Sequence
  Description of Artificial Sequence: Synthetic humanized VH domain of 259A
QVQLVQSGAEVKKPGASVKVSCKASGYTFTSYFMHWVRQAPGQGLEWMGYIYPYNDGTKYAQKFQGRVTMTRDTSTSTVYMELSSLRSEDTAVYYCARFDYDTLRYWGQGTLVTVSS

SEQ ID NO: 1544 - protein, 117 aa, Artificial Sequence
  Description of Artificial Sequence: Synthetic humanized VH domain of 259A
QVQLVQSGAEVKKPGASVKMSCKASGYTFTSYFMHWVRQAPGQGLEWIGYIYPYNDGTKYAQKFQGRATLTSDTSTSTAYMELSSLRSEDTAVYYCARFDYDTLRYWGQGTLLTVSS

SEQ ID NO: 1545 - protein, 117 aa, Artificial Sequence
  Description of Artificial Sequence: Synthetic humanized VH domain of 259A
QVQLVQSGAEVKKPGASVKMSCKASGYTFTSYFMHWVRQAPGQGLEWIGYIYPYNDGTKYAQKFQGRATLTSDKSTSTAYMELSSLRSEDTAVYYCARFDYDTLRYWGQGTLLTVSS

SEQ ID NO: 1546 - protein, 112 aa, Artificial Sequence
  Description of Artificial Sequence: Synthetic humanized VL domain of 124A
DVVMTQSPLSLPVTLGQPASISCRSSQSIVHNNGNTYLEWFQQRPGQSPRRLIYKVSNRFSGVPDRFSGSGSGTDFTLKISRVEAEDVGVYYCFQGSHVPYTFGQGTKLEIK

SEQ ID NO: 1547 - protein, 112 aa, Artificial Sequence
  Description of Artificial Sequence: Synthetic humanized VL domain of 124A
DVVMTQSPLSLPVTLGQPASISCRSSQSIVHNNGNTYLEWYQQRPGQSPRLLIYKVSNRFSGVPDRFSGSGSGTDFTLKISRVEAEDLGVYYCFQGSHVPYTFGQGTKLEIK

SEQ ID NO: 1548 - protein, 112 aa, Artificial Sequence
  Description of Artificial Sequence: Synthetic humanized VL domain of 259A
DIVMTQSPLSLPVTPGEPASISCKSTKSLLNSDGFTYLDWYLQKPGQSPQLLIYLISNRFSGVPDRFSGSGSGTDFTLKISRVEAEDVGVYYCFQSNYFPWTFGQGTKLEIK

SEQ ID NO: 1549 - protein, 112 aa, Artificial Sequence
  Description of Artificial Sequence: Synthetic humanized VL domain of 259A
DIVLTQSPLSLPVTPGEPASISCKSTKSLLNSDGFTYLDWYLQKPGQSPQLLIYLISNRFSGVPDRFSGSGSGTDFTLKISRVEAEDLGVYYCFQSNYFPWTFGQGTKLEIK

SEQ ID NO: 1550 - protein, 25 aa, Artificial Sequence
  Description of Artificial Sequence: Synthetic h26A VH FR1
QVQLVQSGAEVVKPGASVKVSCKAS

SEQ ID NO: 1551 - protein, 25 aa, Artificial Sequence
  Description of Artificial Sequence: Synthetic h26A VH FR1
QVQLVQSGAEVKKPGASMKVSCKAS

SEQ ID NO: 1552 - protein, 25 aa, Artificial Sequence
  Description of Artificial Sequence: Synthetic h26A VH FR1
QVQLVQSGAEVVKPGASMKVSCKAS

SEQ ID NO: 1553 - protein, 25 aa, Artificial Sequence
  Description of Artificial Sequence: Synthetic h26A VH FR1
QVQLVQSGAEVVKPGASVKISCKAS

SEQ ID NO: 1554 - protein, 25 aa, Artificial Sequence
  Description of Artificial Sequence: Synthetic h26A VH FR1
QVQLVQSGAEVKKPGASMKISCKAS

SEQ ID NO: 1555 - protein, 25 aa, Artificial Sequence
  Description of Artificial Sequence: Synthetic h26A VH FR1
QVQLVQSGAEVVKPGASMKISCKAS

SEQ ID NO: 1556 - protein, 10 aa, Artificial Sequence
  Description of Artificial Sequence: Synthetic h26A VH CDR2
LISPYQGGTS

SEQ ID NO: 1557 - protein, 10 aa, Artificial Sequence
  Description of Artificial Sequence: Synthetic h26A VH CDR2
LISPYSGGTS

SEQ ID NO: 1558 - protein, 10 aa, Artificial Sequence
  Description of Artificial Sequence: Synthetic h26A VH CDR2
LISPYAGGTS

SEQ ID NO: 1559 - protein, 10 aa, Artificial Sequence
  Description of Artificial Sequence: Synthetic h26A VH CDR2
LISPYDGGTS

SEQ ID NO: 1560 - protein, 39 aa, Artificial Sequence
  Description of Artificial Sequence: Synthetic h26A VH FR3
YAQKFQGRVTMTRDTSTSTVYMELSSLRSEDTAVYYCAR

SEQ ID NO: 1561 - protein, 39 aa, Artificial Sequence
  Description of Artificial Sequence: Synthetic h26A VH FR3
YNQKFQGRVTMTRDTSTSTVYMELSSLRSEDTAVYYCAR

SEQ ID NO: 1562 - protein, 39 aa, Artificial Sequence
  Description of Artificial Sequence: Synthetic h26A VH FR3
YAQKFQGRATMTRDTSTSTVYMELSSLRSEDTAVYYCAR

SEQ ID NO: 1563 - protein, 39 aa, Artificial Sequence
  Description of Artificial Sequence: Synthetic h26A VH FR3
YAQKFQGRVTLTRDTSTSTVYMELSSLRSEDTAVYYCAR

SEQ ID NO: 1564 - protein, 39 aa, Artificial Sequence
  Description of Artificial Sequence: Synthetic h26A VH FR3
YAQKFQGRVTMTVDTSTSTVYMELSSLRSEDTAVYYCAR

SEQ ID NO: 1565 - protein, 39 aa, Artificial Sequence
  Description of Artificial Sequence: Synthetic h26A VH FR3
YAQKFQGRVTMTRDKSTSTVYMELSSLRSEDTAVYYCAR

SEQ ID NO: 1566 - protein, 39 aa, Artificial Sequence
  Description of Artificial Sequence: Synthetic h26A VH FR3
YAQKFQGRVTMTRDTSTSTAYMELSSLRSEDTAVYYCAR

SEQ ID NO: 1567 - protein, 39 aa, Artificial Sequence
  Description of Artificial Sequence: Synthetic h26A VH FR3
YNQKFQGRATMTRDTSTSTVYMELSSLRSEDTAVYYCAR

SEQ ID NO: 1568 - protein, 39 aa, Artificial Sequence
  Description of Artificial Sequence: Synthetic H26A VH FR3
YNQKFQGRVTLTRDTSTSTVYMELSSLRSEDTAVYYCAR

SEQ ID NO: 1569 - protein, 39 aa, Artificial Sequence
  Description of Artificial Sequence: Synthetic H26A VH FR3
YNQKFQGRVTMTVDTSTSTVYMELSSLRSEDTAVYYCAR

SEQ ID NO: 1570 - protein, 39 aa, Artificial Sequence
  Description of Artificial Sequence: Synthetic H26A VH FR3
YNQKFQGRVTMTRDKSTSTVYMELSSLRSEDTAVYYCAR

SEQ ID NO: 1571 - protein, 39 aa, Artificial Sequence
  Description of Artificial Sequence: Synthetic H26A VH FR3
YNQKFQGRVTMTRDTSTSTAYMELSSLRSEDTAVYYCAR

SEQ ID NO: 1572 - protein, 39 aa, Artificial Sequence
  Description of Artificial Sequence: Synthetic H26A VH FR3
YAQKFQGRATLTRDTSTSTVYMELSSLRSEDTAVYYCAR

SEQ ID NO: 1573 - protein, 39 aa, Artificial Sequence
  Description of Artificial Sequence: Synthetic H26A VH FR3
YAQKFQGRATMTVDTSTSTVYMELSSLRSEDTAVYYCAR

SEQ ID NO: 1574 - protein, 39 aa, Artificial Sequence
  Description of Artificial Sequence: Synthetic H26A VH FR3
YAQKFQGRATMTRDKSTSTVYMELSSLRSEDTAVYYCAR

SEQ ID NO: 1575 - protein, 39 aa, Artificial Sequence
  Description of Artificial Sequence: Synthetic H26A VH FR3
YAQKFQGRATMTRDTSTSTAYMELSSLRSEDTAVYYCAR

SEQ ID NO: 1576 - protein, 39 aa, Artificial Sequence
  Description of Artificial Sequence: Synthetic H26A VH FR3
YAQKFQGRVTLTVDTSTSTVYMELSSLRSEDTAVYYCAR

SEQ ID NO: 1577 - protein, 39 aa, Artificial Sequence
  Description of Artificial Sequence: Synthetic H26A VH FR3
YAQKFQGRVTLTRDKSTSTVYMELSSLRSEDTAVYYCAR

SEQ ID NO: 1578 - protein, 39 aa, Artificial Sequence
  Description of Artificial Sequence: Synthetic H26A VH FR3
YAQKFQGRVTLTRDTSTSTAYMELSSLRSEDTAVYYCAR

SEQ ID NO: 1579 - protein, 39 aa, Artificial Sequence
  Description of Artificial Sequence: Synthetic H26A VH FR3
YAQKFQGRVTMTVDKSTSTVYMELSSLRSEDTAVYYCAR

SEQ ID NO: 1580 - protein, 39 aa, Artificial Sequence
  Description of Artificial Sequence: Synthetic H26A VH FR3
YAQKFQGRVTMTVDTSTSTAYMELSSLRSEDTAVYYCAR

SEQ ID NO: 1581 - protein, 39 aa, Artificial Sequence
  Description of Artificial Sequence: Synthetic H26A VH FR3
YAQKFQGRVTMTRDKSTSTAYMELSSLRSEDTAVYYCAR

SEQ ID NO: 1582 - protein, 39 aa, Artificial Sequence
  Description of Artificial Sequence: Synthetic H26A VH FR3
YNQKFQGRATLTRDTSTSTVYMELSSLRSEDTAVYYCAR

SEQ ID NO: 1583 - protein, 39 aa, Artificial Sequence
  Description of Artificial Sequence: Synthetic H26A VH FR3
YNQKFQGRATMTVDTSTSTVYMELSSLRSEDTAVYYCAR

SEQ ID NO: 1584 - protein, 39 aa, Artificial Sequence
  Description of Artificial Sequence: Synthetic H26A VH FR3
YNQKFQGRATMTRDKSTSTVYMELSSLRSEDTAVYYCAR

SEQ ID NO: 1585 - protein, 39 aa, Artificial Sequence
  Description of Artificial Sequence: Synthetic H26A VH FR3
YNQKFQGRATMTRDTSTSTAYMELSSLRSEDTAVYYCAR

SEQ ID NO: 1586 - protein, 39 aa, Artificial Sequence
  Description of Artificial Sequence: Synthetic H26A VH FR3
YNQKFQGRVTLTVDTSTSTVYMELSSLRSEDTAVYYCAR

SEQ ID NO: 1587 - protein, 39 aa, Artificial Sequence
  Description of Artificial Sequence: Synthetic H26A VH FR3
YNQKFQGRVTLTRDKSTSTVYMELSSLRSEDTAVYYCAR

SEQ ID NO: 1588 - protein, 39 aa, Artificial Sequence
  Description of Artificial Sequence: Synthetic H26A VH FR3
YNQKFQGRVTLTRDTSTSTAYMELSSLRSEDTAVYYCAR

SEQ ID NO: 1589 - protein, 39 aa, Artificial Sequence
  Description of Artificial Sequence: Synthetic H26A VH FR3
YNQKFQGRVTMTVDKSTSTVYMELSSLRSEDTAVYYCAR

SEQ ID NO: 1590 - protein, 39 aa, Artificial Sequence
  Description of Artificial Sequence: Synthetic H26A VH FR3
YNQKFQGRVTMTVDTSTSTAYMELSSLRSEDTAVYYCAR

SEQ ID NO: 1591 - protein, 39 aa, Artificial Sequence
  Description of Artificial Sequence: Synthetic H26A VH FR3
YNQKFQGRVTMTRDKSTSTAYMELSSLRSEDTAVYYCAR

SEQ ID NO: 1592 - protein, 39 aa, Artificial Sequence
  Description of Artificial Sequence: Synthetic H26A VH FR3
YAQKFQGRATLTVDTSTSTVYMELSSLRSEDTAVYYCAR

SEQ ID NO: 1593 - protein, 39 aa, Artificial Sequence
  Description of Artificial Sequence: Synthetic H26A VH FR3
YAQKFQGRATLTRDKSTSTVYMELSSLRSEDTAVYYCAR

SEQ ID NO: 1594 - protein, 39 aa, Artificial Sequence
  Description of Artificial Sequence: Synthetic H26A VH FR3
YAQKFQGRATLTRDTSTSTAYMELSSLRSEDTAVYYCAR

SEQ ID NO: 1595 - protein, 39 aa, Artificial Sequence
  Description of Artificial Sequence: Synthetic H26A VH FR3
YAQKFQGRATMTVDKSTSTVYMELSSLRSEDTAVYYCAR

SEQ ID NO: 1596 - protein, 39 aa, Artificial Sequence
  Description of Artificial Sequence: Synthetic H26A VH FR3
YAQKFQGRATMTVDTSTSTAYMELSSLRSEDTAVYYCAR

SEQ ID NO: 1597 - protein, 39 aa, Artificial Sequence
  Description of Artificial Sequence: Synthetic H26A VH FR3
YAQKFQGRATMTRDKSTSTAYMELSSLRSEDTAVYYCAR

SEQ ID NO: 1598 - protein, 39 aa, Artificial Sequence
  Description of Artificial Sequence: Synthetic H26A VH FR3
YAQKFQGRVTLTVDKSTSTVYMELSSLRSEDTAVYYCAR

SEQ ID NO: 1599 - protein, 39 aa, Artificial Sequence
  Description of Artificial Sequence: Synthetic H26A VH FR3
YAQKFQGRVTLTVDTSTSTAYMELSSLRSEDTAVYYCAR

SEQ ID NO: 1600 - protein, 39 aa, Artificial Sequence
  Description of Artificial Sequence: Synthetic H26A VH FR3
YAQKFQGRVTMTVDKSTSTAYMELSSLRSEDTAVYYCAR

SEQ ID NO: 1601 - protein, 39 aa, Artificial Sequence
  Description of Artificial Sequence: Synthetic H26A VH FR3
YNQKFQGRATLTVDTSTSTVYMELSSLRSEDTAVYYCAR

SEQ ID NO: 1602 - protein, 39 aa, Artificial Sequence
  Description of Artificial Sequence: Synthetic H26A VH FR3
YNQKFQGRATLTRDKSTSTVYMELSSLRSEDTAVYYCAR

SEQ ID NO: 1603 - protein, 39 aa, Artificial Sequence
  Description of Artificial Sequence: Synthetic H26A VH FR3
YNQKFQGRATLTRDTSTSTAYMELSSLRSEDTAVYYCAR

SEQ ID NO: 1604 - protein, 39 aa, Artificial Sequence
  Description of Artificial Sequence: Synthetic H26A VH FR3
YNQKFQGRVTLTVDKSTSTVYMELSSLRSEDTAVYYCAR

SEQ ID NO: 1605 - protein, 39 aa, Artificial Sequence
  Description of Artificial Sequence: Synthetic H26A VH FR3
YNQKFQGRVTLTVDTSTSTAYMELSSLRSEDTAVYYCAR

SEQ ID NO: 1606 - protein, 39 aa, Artificial Sequence
  Description of Artificial Sequence: Synthetic H26A VH FR3
YNQKFQGRVTMTVDKSTSTAYMELSSLRSEDTAVYYCAR

SEQ ID NO: 1607 - protein, 39 aa, Artificial Sequence
  Description of Artificial Sequence: Synthetic H26A VH FR3
YAQKFQGRATLTVDKSTSTVYMELSSLRSEDTAVYYCAR

SEQ ID NO: 1608 - protein, 39 aa, Artificial Sequence
  Description of Artificial Sequence: Synthetic H26A VH FR3
YAQKFQGRATLTVDTSTSTAYMELSSLRSEDTAVYYCAR

SEQ ID NO: 1609 - protein, 39 aa, Artificial Sequence
  Description of Artificial Sequence: Synthetic H26A VH FR3
YAQKFQGRATMTVDKSTSTAYMELSSLRSEDTAVYYCAR

SEQ ID NO: 1610 - protein, 39 aa, Artificial Sequence
  Description of Artificial Sequence: Synthetic H26A VH FR3
YAQKFQGRVTLTVDKSTSTAYMELSSLRSEDTAVYYCAR

SEQ ID NO: 1611 - protein, 39 aa, Artificial Sequence
  Description of Artificial Sequence: Synthetic H26A VH FR3
YNQKFQGRATLTVDKSTSTVYMELSSLRSEDTAVYYCAR

SEQ ID NO: 1612 - protein, 39 aa, Artificial Sequence
  Description of Artificial Sequence: Synthetic H26A VH FR3
YNQKFQGRATLTVDTSTSTAYMELSSLRSEDTAVYYCAR

SEQ ID NO: 1613 - protein, 39 aa, Artificial Sequence
  Description of Artificial Sequence: Synthetic H26A VH FR3
YAQKFQGRATLTVDKSTSTAYMELSSLRSEDTAVYYCAR

SEQ ID NO: 1614 - protein, 39 aa, Artificial Sequence
  Description of Artificial Sequence: Synthetic H26A VH FR3
YNQKFQGRATLTVDKSTSTAYMELSSLRSEDTAVYYCAR

SEQ ID NO: 1615 - protein, 23 aa, Artificial Sequence
  Description of Artificial Sequence: Synthetic h26A VL FR1
EIVLTQSPATLSLSPGERATLSC

SEQ ID NO: 1616 - protein, 23 aa, Artificial Sequence
  Description of Artificial Sequence: Synthetic H26A VL FR1
EIVLTQSPATMSLSPGERATLSC

SEQ ID NO: 1617 - protein, 23 aa, Artificial Sequence
  Description of Artificial Sequence: Synthetic H26A VL FR1
EIVLTQSPATLSASPGERATLSC

SEQ ID NO: 1618 - protein, 23 aa, Artificial Sequence
  Description of Artificial Sequence: Synthetic H26A VL FR1
EIVLTQSPATLSLSPGERVTLSC

SEQ ID NO: 1619 - protein, 23 aa, Artificial Sequence
  Description of Artificial Sequence: Synthetic H26A VL FR1
EIVLTQSPATLSLSPGERATMSC

SEQ ID NO: 1620 - protein, 23 aa, Artificial Sequence
  Description of Artificial Sequence: Synthetic H26A VL FR1
EIVLTQSPATMSASPGERATLSC

SEQ ID NO: 1621 - protein, 23 aa, Artificial Sequence
  Description of Artificial Sequence: Synthetic H26A VL FR1
EIVLTQSPATMSLSPGERVTLSC

SEQ ID NO: 1622 - protein, 23 aa, Artificial Sequence
  Description of Artificial Sequence: Synthetic H26A VL FR1
EIVLTQSPATMSLSPGERATMSC

SEQ ID NO: 1623 - protein, 23 aa, Artificial Sequence
  Description of Artificial Sequence: Synthetic H26A VL FR1
EIVLTQSPATLSASPGERVTLSC

SEQ ID NO: 1624 - protein, 23 aa, Artificial Sequence
  Description of Artificial Sequence: Synthetic H26A VL FR1
EIVLTQSPATLSASPGERATMSC

SEQ ID NO: 1625 - protein, 23 aa, Artificial Sequence
  Description of Artificial Sequence: Synthetic H26A VL FR1
EIVLTQSPATLSLSPGERVTMSC

SEQ ID NO: 1626 - protein, 23 aa, Artificial Sequence
  Description of Artificial Sequence: Synthetic H26A VL FR1
EIVLTQSPATMSASPGERVTLSC

SEQ ID NO: 1627 - protein, 23 aa, Artificial Sequence
  Description of Artificial Sequence: Synthetic H26A VL FR1
EIVLTQSPATMSASPGERATMSC

SEQ ID NO: 1628 - protein, 23 aa, Artificial Sequence
  Description of Artificial Sequence: Synthetic H26A VL FR1
EIVLTQSPATLSASPGERVTMSC

SEQ ID NO: 1629 - protein, 23 aa, Artificial Sequence
  Description of Artificial Sequence: Synthetic H26A VL FR1
EIVLTQSPATMSASPGERVTMSC

SEQ ID NO: 1630 - protein, 7 aa, Artificial Sequence
  Description of Artificial Sequence: Synthetic h26A VL CDR2
DTSQLAS

SEQ ID NO: 1631 - protein, 7 aa, Artificial Sequence
  Description of Artificial Sequence: Synthetic H26A VL CDR2
DTSSLAS

SEQ ID NO: 1632 - protein, 7 aa, Artificial Sequence
  Description of Artificial Sequence: Synthetic H26A VL CDR2
DTSALAS

SEQ ID NO: 1633 - protein, 7 aa, Artificial Sequence
  Description of Artificial Sequence: Synthetic H26A VL CDR2
DTSDLAS

SEQ ID NO: 1634 - protein, 32 aa, Artificial Sequence
  Description of Artificial Sequence: Synthetic h26A VL FR3
GIPARFSGSGSGTDFTLTISSLEPEDFAVYYC

SEQ ID NO: 1635 - protein, 32 aa, Artificial Sequence
  Description of Artificial Sequence: Synthetic H26A VL FR3
GVPARFSGSGSGTDFTLTISSLEPEDFAVYYC

SEQ ID NO: 1636 - protein, 32 aa, Artificial Sequence
  Description of Artificial Sequence: Synthetic H26A VL FR3
GIPARFSGSGSGTDYTLTISSLEPEDFAVYYC

SEQ ID NO: 1637 - protein, 32 aa, Artificial Sequence
  Description of Artificial Sequence: Synthetic H26A VL FR3
GIPARFSGSGSGTDFTLTISSMEPEDFAVYYC

SEQ ID NO: 1638 - protein, 32 aa, Artificial Sequence
  Description of Artificial Sequence: Synthetic H26A VL FR3
GIPARFSGSGSGTDFTLTISSLEPEDAAVYYC

SEQ ID NO: 1639 - protein, 32 aa, Artificial Sequence
  Description of Artificial Sequence: Synthetic H26A VL FR3
GVPARFSGSGSGTDYTLTISSLEPEDFAVYYC

SEQ ID NO: 1640 - protein, 32 aa, Artificial Sequence
  Description of Artificial Sequence: Synthetic H26A VL FR3
GVPARFSGSGSGTDFTLTISSMEPEDFAVYYC

SEQ ID NO: 1641 - protein, 32 aa, Artificial Sequence
  Description of Artificial Sequence: Synthetic H26A VL FR3
GVPARFSGSGSGTDFTLTISSLEPEDAAVYYC

SEQ ID NO: 1642 - protein, 32 aa, Artificial Sequence
  Description of Artificial Sequence: Synthetic H26A VL FR3
GIPARFSGSGSGTDYTLTISSMEPEDFAVYYC

SEQ ID NO: 1643 - protein, 32 aa, Artificial Sequence
  Description of Artificial Sequence: Synthetic H26A VL FR3
GIPARFSGSGSGTDYTLTISSLEPEDAAVYYC

SEQ ID NO: 1644 - protein, 32 aa, Artificial Sequence
  Description of Artificial Sequence: Synthetic H26A VL FR3
GIPARFSGSGSGTDFTLTISSMEPEDAAVYYC

SEQ ID NO: 1645 - protein, 32 aa, Artificial Sequence
  Description of Artificial Sequence: Synthetic H26A VL FR3
GVPARFSGSGSGTDYTLTISSMEPEDFAVYYC

SEQ ID NO: 1646 - protein, 32 aa, Artificial Sequence
  Description of Artificial Sequence: Synthetic H26A VL FR3
GVPARFSGSGSGTDYTLTISSLEPEDAAVYYC

SEQ ID NO: 1647 - protein, 32 aa, Artificial Sequence
  Description of Artificial Sequence: Synthetic H26A VL FR3
GIPARFSGSGSGTDYTLTISSMEPEDAAVYYC

SEQ ID NO: 1648 - protein, 32 aa, Artificial Sequence
  Description of Artificial Sequence: Synthetic H26A VL FR3
GVPARFSGSGSGTDYTLTISSMEPEDAAVYYC

SEQ ID NO: 1649 - protein, 25 aa, Artificial Sequence
  Description of Artificial Sequence: Synthetic h128A VH FR1
QVQLVQSGAEVKKPGASVKVSCKGS

SEQ ID NO: 1650 - protein, 25 aa, Artificial Sequence
  Description of Artificial Sequence: Synthetic H128A VH FR1
QVQLVQSGAEVVKPGASVKVSCKGS

SEQ ID NO: 1651 - protein, 25 aa, Artificial Sequence
  Description of Artificial Sequence: Synthetic H128A VH FR1
QVQLVQSGAEVKKPGASVKISCKGS

SEQ ID NO: 1652 - protein, 25 aa, Artificial Sequence
  Description of Artificial Sequence: Synthetic H128A VH FR1
QVQLVQSGAEVVKPGASVKISCKGS

SEQ ID NO: 1653 - protein, 39 aa, Artificial Sequence
  Description of Artificial Sequence: Synthetic H128A VH FR3
YAQKFQGRVTMTRDTSTSTVYMELSSLRSEDTAIYYCAR

SEQ ID NO: 1654 - protein, 39 aa, Artificial Sequence
  Description of Artificial Sequence: Synthetic H128A VH FR3
YNQKFQGRVTMTRDTSTSTVYMELSSLRSEDTAIYYCAR

SEQ ID NO: 1655 - protein, 39 aa, Artificial Sequence
  Description of Artificial Sequence: Synthetic H128A VH FR3
YAQKFQGRATMTRDTSTSTVYMELSSLRSEDTAIYYCAR

SEQ ID NO: 1656 - protein, 39 aa, Artificial Sequence
  Description of Artificial Sequence: Synthetic H128A VH FR3
YAQKFQGRVTMTVDTSTSTVYMELSSLRSEDTAIYYCAR

SEQ ID NO: 1657 - protein, 39 aa, Artificial Sequence
  Description of Artificial Sequence: Synthetic H128A VH FR3
YAQKFQGRVTMTRDKSTSTVYMELSSLRSEDTAIYYCAR

SEQ ID NO: 1658 - protein, 39 aa, Artificial Sequence
  Description of Artificial Sequence: Synthetic H128A VH FR3
YAQKFQGRVTMTRDTSTSTAYMELSSLRSEDTAIYYCAR

SEQ ID NO: 1659 - protein, 39 aa, Artificial Sequence
  Description of Artificial Sequence: Synthetic H128A VH FR3
YNQKFQGRATMTRDTSTSTVYMELSSLRSEDTAIYYCAR

SEQ ID NO: 1660 - protein, 39 aa, Artificial Sequence
  Description of Artificial Sequence: Synthetic H128A VH FR3
YNQKFQGRVTMTVDTSTSTVYMELSSLRSEDTAIYYCAR

SEQ ID NO: 1661 - protein, 39 aa, Artificial Sequence
  Description of Artificial Sequence: Synthetic H128A VH FR3
YNQKFQGRVTMTRDKSTSTVYMELSSLRSEDTAIYYCAR

SEQ ID NO: 1662 - protein, 39 aa, Artificial Sequence
  Description of Artificial Sequence: Synthetic H128A VH FR3
YNQKFQGRVTMTRDTSTSTAYMELSSLRSEDTAIYYCAR

SEQ ID NO: 1663 - protein, 39 aa, Artificial Sequence
  Description of Artificial Sequence: Synthetic H128A VH FR3
YAQKFQGRATMTVDTSTSTVYMELSSLRSEDTAIYYCAR

SEQ ID NO: 1664 - protein, 39 aa, Artificial Sequence
  Description of Artificial Sequence: Synthetic H128A VH FR3
YAQKFQGRATMTRDKSTSTVYMELSSLRSEDTAIYYCAR

SEQ ID NO: 1665 - protein, 39 aa, Artificial Sequence
  Description of Artificial Sequence: Synthetic H128A VH FR3
YAQKFQGRATMTRDTSTSTAYMELSSLRSEDTAIYYCAR

SEQ ID NO: 1666 - protein, 39 aa, Artificial Sequence
  Description of Artificial Sequence: Synthetic H128A VH FR3
YAQKFQGRVTMTVDKSTSTVYMELSSLRSEDTAIYYCAR

SEQ ID NO: 1667 - protein, 39 aa, Artificial Sequence
  Description of Artificial Sequence: Synthetic H128A VH FR3
YAQKFQGRVTMTRDKSTSTAYMELSSLRSEDTAIYYCAR

SEQ ID NO: 1668 - protein, 39 aa, Artificial Sequence
  Description of Artificial Sequence: Synthetic H128A VH FR3
YNQKFQGRATMTVDKSTSTVYMELSSLRSEDTAVYYCAR

SEQ ID NO: 1669 - protein, 39 aa, Artificial Sequence
  Description of Artificial Sequence: Synthetic H128A VH FR3
YNQKFQGRATMTVDTSTSTAYMELSSLRSEDTAVYYCAR

SEQ ID NO: 1670 - protein, 39 aa, Artificial Sequence
  Description of Artificial Sequence: Synthetic H128A VH FR3
YNQKFQGRATMTVDTSTSTVYMELSSLRSEDTAIYYCAR

SEQ ID NO: 1671 - protein, 39 aa, Artificial Sequence
  Description of Artificial Sequence: Synthetic H128A VH FR3
YNQKFQGRVTMTVDKSTSTVYMELSSLRSEDTAIYYCAR

SEQ ID NO: 1672 - protein, 39 aa, Artificial Sequence
  Description of Artificial Sequence: Synthetic H128A VH FR3
YNQKFQGRVTMTRDKSTSTAYMELSSLRSEDTAIYYCAR

SEQ ID NO: 1673 - protein, 39 aa, Artificial Sequence
  Description of Artificial Sequence: Synthetic H128A VH FR3
YAQKFQGRATMTVDKSTSTVYMELSSLRSEDTAIYYCAR

SEQ ID NO: 1674 - protein, 39 aa, Artificial Sequence
  Description of Artificial Sequence: Synthetic H128A VH FR3
YAQKFQGRATMTRDKSTSTAYMELSSLRSEDTAIYYCAR

SEQ ID NO: 1675 - protein, 39 aa, Artificial Sequence
  Description of Artificial Sequence: Synthetic H128A VH FR3
YAQKFQGRVTMTVDKSTSTAYMELSSLRSEDTAIYYCAR

SEQ ID NO: 1676 - protein, 39 aa, Artificial Sequence
  Description of Artificial Sequence: Synthetic H128A VH FR3
YNQKFQGRATMTVDKSTSTAYMELSSLRSEDTAVYYCAR

SEQ ID NO: 1677 - protein, 39 aa, Artificial Sequence
  Description of Artificial Sequence: Synthetic H128A VH FR3
YNQKFQGRATMTVDKSTSTVYMELSSLRSEDTAAYYCAR

SEQ ID NO: 1678 - protein, 39 aa, Artificial Sequence
  Description of Artificial Sequence: Synthetic H128A VH FR3
YAQKFQGRATMTVDKSTSTAYMELSSLRSEDTAAYYCAR

SEQ ID NO: 1679 - protein, 39 aa, Artificial Sequence
  Description of Artificial Sequence: Synthetic H128A VH FR3
YNQKFQGRATMTVDKSTSTAYMELSSLRSEDTAAYYCAR

SEQ ID NO: 1680 - protein, 11 aa, Artificial Sequence
  Description of Artificial Sequence: Synthetic H128A VH FR4
WGQGTLVTASS

SEQ ID NO: 1681 - protein, 11 aa, Artificial Sequence
  Description of Artificial Sequence: Synthetic H128A VL CDR1
KASQSVSQDIA

SEQ ID NO: 1682 - protein, 11 aa, Artificial Sequence
  Description of Artificial Sequence: Synthetic H128A VL CDR1
KASQSVSSDIA

SEQ ID NO: 1683 - protein, 11 aa, Artificial Sequence
  Description of Artificial Sequence: Synthetic H128A VL CDR1
KASQSVSADIA

SEQ ID NO: 1684 - protein, 11 aa, Artificial Sequence
  Description of Artificial Sequence: Synthetic H128A VL CDR1
KASQSVSDDIA

SEQ ID NO: 1685 - protein, 7 aa, Artificial Sequence
  Description of Artificial Sequence: Synthetic H128A VL CDR2
YASQRYT

SEQ ID NO: 1686 - protein, 7 aa, Artificial Sequence
  Description of Artificial Sequence: Synthetic H128A VL CDR2
YASSRYT

SEQ ID NO: 1687 - protein, 7 aa, Artificial Sequence
  Description of Artificial Sequence: Synthetic H128A VL CDR2
YASARYT

SEQ ID NO: 1688 - protein, 7 aa, Artificial Sequence
  Description of Artificial Sequence: Synthetic H128A VL CDR2
YASDRYT

SEQ ID NO: 1689 - protein, 32 aa, Artificial Sequence
  Description of Artificial Sequence: Synthetic H128A VL CDR3
GVPSRFSGSGYGTDFTLTISSLQPEDFATYYC

SEQ ID NO: 1690 - protein, 32 aa, Artificial Sequence
  Description of Artificial Sequence: Synthetic H128A VL CDR3
GVPSRFSGSGSGTDFTFTISSLQPEDFATYYC

SEQ ID NO: 1691 - protein, 32 aa, Artificial Sequence
  Description of Artificial Sequence: Synthetic H128A VL CDR3
GVPSRFSGSGSGTDFTLTISSLQPEDFATYFC

SEQ ID NO: 1692 - protein, 32 aa, Artificial Sequence
  Description of Artificial Sequence: Synthetic H128A VL CDR3
GVPSRFSGSGYGTDFTFTISSLQPEDFATYYC

SEQ ID NO: 1693 - protein, 32 aa, Artificial Sequence
  Description of Artificial Sequence: Synthetic H128A VL CDR3
GVPSRFSGSGYGTDFTLTISSVQPEDFATYYC

SEQ ID NO: 1694 - protein, 32 aa, Artificial Sequence
  Description of Artificial Sequence: Synthetic H128A VL CDR3
GVPSRFSGSGYGTDFTLTISSLQPEDLATYYC

SEQ ID NO: 1695 - protein, 32 aa, Artificial Sequence
  Description of Artificial Sequence: Synthetic H128A VL CDR3
GVPSRFSGSGYGTDFTLTISSLQPEDFATYFC

SEQ ID NO: 1696 - protein, 32 aa, Artificial Sequence
  Description of Artificial Sequence: Synthetic H128A VL CDR3
GVPSRFSGSGSGTDFTFTISSVQPEDFATYYC

SEQ ID NO: 1697 - protein, 32 aa, Artificial Sequence
  Description of Artificial Sequence: Synthetic H128A VL CDR3
GVPSRFSGSGSGTDFTFTISSLQPEDLATYYC

SEQ ID NO: 1698 - protein, 32 aa, Artificial Sequence
  Description of Artificial Sequence: Synthetic H128A VL CDR3
GVPSRFSGSGSGTDFTFTISSLQPEDFATYFC

SEQ ID NO: 1699 - protein, 32 aa, Artificial Sequence
  Description of Artificial Sequence: Synthetic H128A VL CDR3
GVPSRFSGSGSGTDFTLTISSVQPEDFATYFC

SEQ ID NO: 1700 - protein, 32 aa, Artificial Sequence
  Description of Artificial Sequence: Synthetic H128A VL CDR3
GVPSRFSGSGSGTDFTLTISSLQPEDLATYFC

SEQ ID NO: 1701 - protein, 32 aa, Artificial Sequence
  Description of Artificial Sequence: Synthetic H128A VL CDR3
GVPSRFSGSGYGTDFTFTISSVQPEDFATYYC

SEQ ID NO: 1702 - protein, 32 aa, Artificial Sequence
  Description of Artificial Sequence: Synthetic H128A VL CDR3
GVPSRFSGSGYGTDFTFTISSLQPEDLATYYC

SEQ ID NO: 1703 - protein, 32 aa, Artificial Sequence
  Description of Artificial Sequence: Synthetic H128A VL CDR3
GVPSRFSGSGYGTDFTFTISSLQPEDFATYFC

SEQ ID NO: 1704 - protein, 32 aa, Artificial Sequence
  Description of Artificial Sequence: Synthetic H128A VL CDR3
GVPSRFSGSGYGTDFTLTISSVQPEDLATYYC

SEQ ID NO: 1705 - protein, 32 aa, Artificial Sequence
  Description of Artificial Sequence: Synthetic H128A VL CDR3
GVPSRFSGSGYGTDFTLTISSVQPEDFATYFC

SEQ ID NO: 1706 - protein, 32 aa, Artificial Sequence
  Description of Artificial Sequence: Synthetic H128A VL CDR3
GVPSRFSGSGYGTDFTLTISSLQPEDLATYFC

SEQ ID NO: 1707 - protein, 32 aa, Artificial Sequence
  Description of Artificial Sequence: Synthetic H128A VL CDR3
GVPSRFSGSGSGTDFTFTISSVQPEDLATYYC

SEQ ID NO: 1708 - protein, 32 aa, Artificial Sequence
  Description of Artificial Sequence: Synthetic H128A VL CDR3
GVPSRFSGSGSGTDFTFTISSVQPEDFATYFC

SEQ ID NO: 1709 - protein, 32 aa, Artificial Sequence
  Description of Artificial Sequence: Synthetic H128A VL CDR3
GVPSRFSGSGSGTDFTLTISSVQPEDLATYFC

SEQ ID NO: 1710 - protein, 32 aa, Artificial Sequence
  Description of Artificial Sequence: Synthetic H128A VL CDR3
GVPSRFSGSGYGTDFTFTISSVQPEDLATYYC

SEQ ID NO: 1711 - protein, 32 aa, Artificial Sequence
  Description of Artificial Sequence: Synthetic H128A VL CDR3
GVPSRFSGSGYGTDFTFTISSVQPEDFATYFC

SEQ ID NO: 1712 - protein, 32 aa, Artificial Sequence
  Description of Artificial Sequence: Synthetic H128A VL CDR3
GVPSRFSGSGYGTDFTLTISSVQPEDLATYFC

SEQ ID NO: 1713 - protein, 32 aa, Artificial Sequence
  Description of Artificial Sequence: Synthetic H128A VL CDR3
GVPSRFSGSGSGTDFTFTISSVQPEDLATYFC

SEQ ID NO: 1714 - protein, 32 aa, Artificial Sequence
  Description of Artificial Sequence: Synthetic H128A VL CDR3
GVPSRFSGSGYGTDFTFTISSVQPEDLATYFC

SEQ ID NO: 1715 - protein, 25 aa, Artificial Sequence
  Description of Artificial Sequence: Synthetic H124A VH FR1
QVQLVQSGAEVKKPGASIKVSCKAS

SEQ ID NO: 1716 - protein, 25 aa, Artificial Sequence
  Description of Artificial Sequence: Synthetic H124A VH FR1
QVQLVQSGAEVMKPGASIKVSCKAS

SEQ ID NO: 1717 - protein, 10 aa, Artificial Sequence
  Description of Artificial Sequence: Synthetic H124A VH CDR1
GYTFSSQWIE

SEQ ID NO: 1718 - protein, 10 aa, Artificial Sequence
  Description of Artificial Sequence: Synthetic H124A VH CDR1
GYTFSSSWIE

SEQ ID NO: 1719 - protein, 10 aa, Artificial Sequence
  Description of Artificial Sequence: Synthetic H124A VH CDR1
GYTFSSAWIE

SEQ ID NO: 1720 - protein, 10 aa, Artificial Sequence
  Description of Artificial Sequence: Synthetic H124A VH CDR1
GYTFSSDWIE

SEQ ID NO: 1721 - protein, 39 aa, Artificial Sequence
  Description of Artificial Sequence: Synthetic H124A VH FR3
YAQKFQGRVTFTRDTSTSTVYMELSSLRSEDTAVYYCAR

SEQ ID NO: 1722 - protein, 39 aa, Artificial Sequence
  Description of Artificial Sequence: Synthetic H124A VH FR3
YAQKFQGRVTMTADTSTSTVYMELSSLRSEDTAVYYCAR

SEQ ID NO: 1723 - protein, 39 aa, Artificial Sequence
  Description of Artificial Sequence: Synthetic H124A VH FR3
YNQKFQGRVTFTRDTSTSTVYMELSSLRSEDTAVYYCAR

SEQ ID NO: 1724 - protein, 39 aa, Artificial Sequence
  Description of Artificial Sequence: Synthetic H124A VH FR3
YNQKFQGRVTMTADTSTSTVYMELSSLRSEDTAVYYCAR

SEQ ID NO: 1725 - protein, 39 aa, Artificial Sequence
  Description of Artificial Sequence: Synthetic H124A VH FR3
YAQKFQGRATFTRDTSTSTVYMELSSLRSEDTAVYYCAR

SEQ ID NO: 1726 - protein, 39 aa, Artificial Sequence
  Description of Artificial Sequence: Synthetic H124A VH FR3
YAQKFQGRATMTADTSTSTVYMELSSLRSEDTAVYYCAR

SEQ ID NO: 1727 - protein, 39 aa, Artificial Sequence
  Description of Artificial Sequence: Synthetic H124A VH FR3
YAQKFQGRVTFTADTSTSTVYMELSSLRSEDTAVYYCAR

SEQ ID NO: 1728 - protein, 39 aa, Artificial Sequence
  Description of Artificial Sequence: Synthetic H124A VH FR3
YAQKFQGRVTFTRDTSTSTAYMELSSLRSEDTAVYYCAR

SEQ ID NO: 1729 - protein, 39 aa, Artificial Sequence
  Description of Artificial Sequence: Synthetic H124A VH FR3
YAQKFQGRVTMTADTSTSTAYMELSSLRSEDTAVYYCAR

SEQ ID NO: 1730 - protein, 39 aa, Artificial Sequence
  Description of Artificial Sequence: Synthetic H124A VH FR3
YNQKFQGRATFTRDTSTSTVYMELSSLRSEDTAVYYCAR

SEQ ID NO: 1731 - protein, 39 aa, Artificial Sequence
  Description of Artificial Sequence: Synthetic H124A VH FR3
YNQKFQGRATMTADTSTSTVYMELSSLRSEDTAVYYCAR

SEQ ID NO: 1732 - protein, 39 aa, Artificial Sequence
  Description of Artificial Sequence: Synthetic H124A VH FR3
YNQKFQGRVTFTADTSTSTVYMELSSLRSEDTAVYYCAR

SEQ ID NO: 1733 - protein, 39 aa, Artificial Sequence
  Description of Artificial Sequence: Synthetic H124A VH FR3
YNQKFQGRVTFTRDTSTSTAYMELSSLRSEDTAVYYCAR

SEQ ID NO: 1734 - protein, 39 aa, Artificial Sequence
  Description of Artificial Sequence: Synthetic H124A VH FR3
YNQKFQGRVTMTADTSTSTAYMELSSLRSEDTAVYYCAR

SEQ ID NO: 1735 - protein, 39 aa, Artificial Sequence
  Description of Artificial Sequence: Synthetic H124A VH FR3
YAQKFQGRATFTADTSTSTVYMELSSLRSEDTAVYYCAR

SEQ ID NO: 1736 - protein, 39 aa, Artificial Sequence
  Description of Artificial Sequence: Synthetic H124A VH FR3
YAQKFQGRATFTRDTSTSTAYMELSSLRSEDTAVYYCAR

SEQ ID NO: 1737 - protein, 39 aa, Artificial Sequence
  Description of Artificial Sequence: Synthetic H124A VH FR3
YAQKFQGRATMTADTSTSTAYMELSSLRSEDTAVYYCAR

SEQ ID NO: 1738 - protein, 39 aa, Artificial Sequence
  Description of Artificial Sequence: Synthetic H124A VH FR3
YAQKFQGRVTFTADTSTSTAYMELSSLRSEDTAVYYCAR

SEQ ID NO: 1739 - protein, 39 aa, Artificial Sequence
  Description of Artificial Sequence: Synthetic H124A VH FR3
YNQKFQGRATFTADTSTSTVYMELSSLRSEDTAVYYCAR

SEQ ID NO: 1740 - protein, 39 aa, Artificial Sequence
  Description of Artificial Sequence: Synthetic H124A VH FR3
YNQKFQGRATFTRDTSTSTAYMELSSLRSEDTAVYYCAR

SEQ ID NO: 1741 - protein, 39 aa, Artificial Sequence
  Description of Artificial Sequence: Synthetic H124A VH FR3
YNQKFQGRATMTADTSTSTAYMELSSLRSEDTAVYYCAR

SEQ ID NO: 1742 - protein, 39 aa, Artificial Sequence
  Description of Artificial Sequence: Synthetic H124A VH FR3
YNQKFQGRATFTADTSTSTAYMELSSLRSEDTAVYYCAR

SEQ ID NO: 1743 - protein, 23 aa, Artificial Sequence
  Description of Artificial Sequence: Synthetic H124A VL FR1
DVVMTQSPLSLPVTLGQPASISC

SEQ ID NO: 1744 - protein, 16 aa, Artificial Sequence
  Description of Artificial Sequence: Synthetic H124A VL CDR1
RSSQSIVHQNGNTYLE

SEQ ID NO: 1745 - protein, 16 aa, Artificial Sequence
  Description of Artificial Sequence: Synthetic H124A VL CDR1
RSSQSIVHANGNTYLE

SEQ ID NO: 1746 - protein, 16 aa, Artificial Sequence
  Description of Artificial Sequence: Synthetic H124A VL CDR1
RSSQSIVHDNGNTYLE

SEQ ID NO: 1747 - protein, 16 aa, Artificial Sequence
  Description of Artificial Sequence: Synthetic H124A VL CDR1
RSSQSIVHNQGNTYLE

SEQ ID NO: 1748 - protein, 16 aa, Artificial Sequence
  Description of Artificial Sequence: Synthetic H124A VL CDR1
RSSQSIVHNSGNTYLE

SEQ ID NO: 1749 - protein, 16 aa, Artificial Sequence
  Description of Artificial Sequence: Synthetic H124A VL CDR1
RSSQSIVHNAGNTYLE

SEQ ID NO: 1750 - protein, 16 aa, Artificial Sequence
  Description of Artificial Sequence: Synthetic H124A VL CDR1
RSSQSIVHNNGQTYLE

SEQ ID NO: 1751 - protein, 16 aa, Artificial Sequence
  Description of Artificial Sequence: Synthetic H124A VL CDR1
RSSQSIVHNNGSTYLE

SEQ ID NO: 1752 - protein, 16 aa, Artificial Sequence
  Description of Artificial Sequence: Synthetic H124A VL CDR1
RSSQSIVHNNGATYLE

SEQ ID NO: 1753 - protein, 16 aa, Artificial Sequence
  Description of Artificial Sequence: Synthetic H124A VL CDR1
RSSQSIVHNNGDTYLE

SEQ ID NO: 1754 - protein, 16 aa, Artificial Sequence
  Description of Artificial Sequence: Synthetic H124A VL CDR1
RSSQSIVHQQGNTYLE

SEQ ID NO: 1755 - protein, 16 aa, Artificial Sequence
  Description of Artificial Sequence: Synthetic H124A VL CDR1
RSSQSIVHQSGNTYLE

SEQ ID NO: 1756 - protein, 16 aa, Artificial Sequence
  Description of Artificial Sequence: Synthetic H124A VL CDR1
RSSQSIVHQAGNTYLE

SEQ ID NO: 1757 - protein, 16 aa, Artificial Sequence
  Description of Artificial Sequence: Synthetic H124A VL CDR1
RSSQSIVHQNGQTYLE

SEQ ID NO: 1758 - protein, 16 aa, Artificial Sequence
  Description of Artificial Sequence: Synthetic H124A VL CDR1
RSSQSIVHQNGSTYLE

SEQ ID NO: 1759 - protein, 16 aa, Artificial Sequence
  Description of Artificial Sequence: Synthetic H124A VL CDR1
RSSQSIVHQNGATYLE

SEQ ID NO: 1760 - protein, 16 aa, Artificial Sequence
  Description of Artificial Sequence: Synthetic H124A VL CDR1
RSSQSIVHQNGDTYLE

SEQ ID NO: 1761 - protein, 16 aa, Artificial Sequence
  Description of Artificial Sequence: Synthetic H124A VL CDR1
RSSQSIVHAQGNTYLE

SEQ ID NO: 1762 - protein, 16 aa, Artificial Sequence
  Description of Artificial Sequence: Synthetic H124A VL CDR1
RSSQSIVHASGNTYLE

SEQ ID NO: 1763 - protein, 16 aa, Artificial Sequence
  Description of Artificial Sequence: Synthetic H124A VL CDR1
RSSQSIVHAAGNTYLE

SEQ ID NO: 1764 - protein, 16 aa, Artificial Sequence
  Description of Artificial Sequence: Synthetic H124A VL CDR1
RSSQSIVHANGQTYLE

SEQ ID NO: 1765 - protein, 16 aa, Artificial Sequence
  Description of Artificial Sequence: Synthetic H124A VL CDR1
RSSQSIVHANGSTYLE

SEQ ID NO: 1766 - protein, 16 aa, Artificial Sequence
  Description of Artificial Sequence: Synthetic H124A VL CDR1
RSSQSIVHANGATYLE

SEQ ID NO: 1767 - protein, 16 aa, Artificial Sequence
  Description of Artificial Sequence: Synthetic H124A VL CDR1
RSSQSIVHANGDTYLE

SEQ ID NO: 1768 - protein, 16 aa, Artificial Sequence
  Description of Artificial Sequence: Synthetic H124A VL CDR1
RSSQSIVHDQGNTYLE

SEQ ID NO: 1769 - protein, 16 aa, Artificial Sequence
  Description of Artificial Sequence: Synthetic H124A VL CDR1
RSSQSIVHDSGNTYLE

SEQ ID NO: 1770 - protein, 16 aa, Artificial Sequence
  Description of Artificial Sequence: Synthetic H124A VL CDR1
RSSQSIVHDAGNTYLE

SEQ ID NO: 1771 - protein, 16 aa, Artificial Sequence
  Description of Artificial Sequence: Synthetic H124A VL CDR1
RSSQSIVHDNGQTYLE

SEQ ID NO: 1772 - protein, 16 aa, Artificial Sequence
  Description of Artificial Sequence: Synthetic H124A VL CDR1
RSSQSIVHDNGSTYLE

SEQ ID NO: 1773 - protein, 16 aa, Artificial Sequence
  Description of Artificial Sequence: Synthetic H124A VL CDR1
RSSQSIVHDNGATYLE

SEQ ID NO: 1774 - protein, 16 aa, Artificial Sequence
  Description of Artificial Sequence: Synthetic H124A VL CDR1
RSSQSIVHDNGDTYLE

SEQ ID NO: 1775 - protein, 16 aa, Artificial Sequence
  Description of Artificial Sequence: Synthetic H124A VL CDR1
RSSQSIVHNQGQTYLE

SEQ ID NO: 1776 - protein, 16 aa, Artificial Sequence
  Description of Artificial Sequence: Synthetic H124A VL CDR1
RSSQSIVHNQGSTYLE

SEQ ID NO: 1777 - protein, 16 aa, Artificial Sequence
  Description of Artificial Sequence: Synthetic H124A VL CDR1
RSSQSIVHNQGATYLE

SEQ ID NO: 1778 - protein, 16 aa, Artificial Sequence
  Description of Artificial Sequence: Synthetic H124A VL CDR1
RSSQSIVHNQGDTYLE

SEQ ID NO: 1779 - protein, 16 aa, Artificial Sequence
  Description of Artificial Sequence: Synthetic H124A VL CDR1
RSSQSIVHNSGQTYLE

SEQ ID NO: 1780 - protein, 16 aa, Artificial Sequence
  Description of Artificial Sequence: Synthetic H124A VL CDR1
RSSQSIVHNSGSTYLE

SEQ ID NO: 1781 - protein, 16 aa, Artificial Sequence
  Description of Artificial Sequence: Synthetic H124A VL CDR1
RSSQSIVHNSGATYLE

SEQ ID NO: 1782 - protein, 16 aa, Artificial Sequence
  Description of Artificial Sequence: Synthetic H124A VL CDR1
RSSQSIVHNSGDTYLE

SEQ ID NO: 1783 - protein, 16 aa, Artificial Sequence
  Description of Artificial Sequence: Synthetic H124A VL CDR1
RSSQSIVHNAGQTYLE

SEQ ID NO: 1784 - protein, 16 aa, Artificial Sequence
  Description of Artificial Sequence: Synthetic H124A VL CDR1
RSSQSIVHNAGSTYLE

SEQ ID NO: 1785 - protein, 16 aa, Artificial Sequence
  Description of Artificial Sequence: Synthetic H124A VL CDR1
RSSQSIVHNAGATYLE

SEQ ID NO: 1786 - protein, 16 aa, Artificial Sequence
  Description of Artificial Sequence: Synthetic H124A VL CDR1
RSSQSIVHNAGDTYLE

SEQ ID NO: 1787 - protein, 16 aa, Artificial Sequence
  Description of Artificial Sequence: Synthetic H124A VL CDR1
RSSQSIVHQQGQTYLE

SEQ ID NO: 1788 - protein, 16 aa, Artificial Sequence
  Description of Artificial Sequence: Synthetic H124A VL CDR1
RSSQSIVHAQGQTYLE

SEQ ID NO: 1789 - protein, 16 aa, Artificial Sequence
  Description of Artificial Sequence: Synthetic H124A VL CDR1
RSSQSIVHDQGQTYLE

SEQ ID NO: 1790 - protein, 16 aa, Artificial Sequence
  Description of Artificial Sequence: Synthetic H124A VL CDR1
RSSQSIVHQSGQTYLE

SEQ ID NO: 1791 - protein, 16 aa, Artificial Sequence
  Description of Artificial Sequence: Synthetic H124A VL CDR1
RSSQSIVHQAGQTYLE

SEQ ID NO: 1792 - protein, 16 aa, Artificial Sequence
  Description of Artificial Sequence: Synthetic H124A VL CDR1
RSSQSIVHASGQTYLE

SEQ ID NO: 1793 - protein, 16 aa, Artificial Sequence
  Description of Artificial Sequence: Synthetic H124A VL CDR1
RSSQSIVHAAGQTYLE

SEQ ID NO: 1794 - protein, 16 aa, Artificial Sequence
  Description of Artificial Sequence: Synthetic H124A VL CDR1
RSSQSIVHDSGQTYLE

SEQ ID NO: 1795 - protein, 16 aa, Artificial Sequence
  Description of Artificial Sequence: Synthetic H124A VL CDR1
RSSQSIVHDAGQTYLE

SEQ ID NO: 1796 - protein, 16 aa, Artificial Sequence
  Description of Artificial Sequence: Synthetic H124A VL CDR1
RSSQSIVHQQGSTYLE

SEQ ID NO: 1797 - protein, 16 aa, Artificial Sequence
  Description of Artificial Sequence: Synthetic H124A VL CDR1
RSSQSIVHAQGSTYLE

SEQ ID NO: 1798 - protein, 16 aa, Artificial Sequence
  Description of Artificial Sequence: Synthetic H124A VL CDR1
RSSQSIVHDQGSTYLE

SEQ ID NO: 1799 - protein, 16 aa, Artificial Sequence
  Description of Artificial Sequence: Synthetic H124A VL CDR1
RSSQSIVHQSGSTYLE

SEQ ID NO: 1800 - protein, 16 aa, Artificial Sequence
  Description of Artificial Sequence: Synthetic H124A VL CDR1
RSSQSIVHQAGSTYLE

SEQ ID NO: 1801 - protein, 16 aa, Artificial Sequence
  Description of Artificial Sequence: Synthetic H124A VL CDR1
RSSQSIVHASGSTYLE

SEQ ID NO: 1802 - protein, 16 aa, Artificial Sequence
  Description of Artificial Sequence: Synthetic H124A VL CDR1
RSSQSIVHAAGSTYLE

SEQ ID NO: 1803 - protein, 16 aa, Artificial Sequence
  Description of Artificial Sequence: Synthetic H124A VL CDR1
RSSQSIVHDSGSTYLE

SEQ ID NO: 1804 - protein, 16 aa, Artificial Sequence
  Description of Artificial Sequence: Synthetic H124A VL CDR1
RSSQSIVHDAGSTYLE

SEQ ID NO: 1805 - protein, 16 aa, Artificial Sequence
  Description of Artificial Sequence: Synthetic H124A VL CDR1
RSSQSIVHQQGATYLE

SEQ ID NO: 1806 - protein, 16 aa, Artificial Sequence
  Description of Artificial Sequence: Synthetic H124A VL CDR1
RSSQSIVHAQGATYLE

SEQ ID NO: 1807 - protein, 16 aa, Artificial Sequence
  Description of Artificial Sequence: Synthetic H124A VL CDR1
RSSQSIVHDQGATYLE

SEQ ID NO: 1808 - protein, 16 aa, Artificial Sequence
  Description of Artificial Sequence: Synthetic H124A VL CDR1
RSSQSIVHQSGATYLE

SEQ ID NO: 1809 - protein, 16 aa, Artificial Sequence
  Description of Artificial Sequence: Synthetic H124A VL CDR1
RSSQSIVHQAGATYLE

SEQ ID NO: 1810 - protein, 16 aa, Artificial Sequence
  Description of Artificial Sequence: Synthetic H124A VL CDR1
RSSQSIVHASGATYLE

SEQ ID NO: 1811 - protein, 16 aa, Artificial Sequence
  Description of Artificial Sequence: Synthetic H124A VL CDR1
RSSQSIVHAAGATYLE

SEQ ID NO: 1812 - protein, 16 aa, Artificial Sequence
  Description of Artificial Sequence: Synthetic H124A VL CDR1
RSSQSIVHDSGATYLE

SEQ ID NO: 1813 - protein, 16 aa, Artificial Sequence
  Description of Artificial Sequence: Synthetic H124A VL CDR1
RSSQSIVHDAGATYLE

SEQ ID NO: 1814 - protein, 16 aa, Artificial Sequence
  Description of Artificial Sequence: Synthetic H124A VL CDR1
RSSQSIVHQQGDTYLE

SEQ ID NO: 1815 - protein, 16 aa, Artificial Sequence
  Description of Artificial Sequence: Synthetic H124A VL CDR1
RSSQSIVHAQGDTYLE

SEQ ID NO: 1816 - protein, 16 aa, Artificial Sequence
  Description of Artificial Sequence: Synthetic H124A VL CDR1
RSSQSIVHDQGDTYLE

SEQ ID NO: 1817 - protein, 16 aa, Artificial Sequence
  Description of Artificial Sequence: Synthetic H124A VL CDR1
RSSQSIVHQSGDTYLE

SEQ ID NO: 1818 - protein, 16 aa, Artificial Sequence
  Description of Artificial Sequence: Synthetic H124A VL CDR1
RSSQSIVHQAGDTYLE

SEQ ID NO: 1819 - protein, 16 aa, Artificial Sequence
  Description of Artificial Sequence: Synthetic H124A VL CDR1
RSSQSIVHASGDTYLE

SEQ ID NO: 1820 - protein, 16 aa, Artificial Sequence
  Description of Artificial Sequence: Synthetic H124A VL CDR1
RSSQSIVHAAGDTYLE

SEQ ID NO: 1821 - protein, 16 aa, Artificial Sequence
  Description of Artificial Sequence: Synthetic H124A VL CDR1
RSSQSIVHDSGDTYLE

SEQ ID NO: 1822 - protein, 16 aa, Artificial Sequence
  Description of Artificial Sequence: Synthetic H124A VL CDR1
RSSQSIVHDAGDTYLE

SEQ ID NO: 1823 - protein, 15 aa, Artificial Sequence
  Description of Artificial Sequence: Synthetic H124A VL FR2
WFQQRPGQSPRRLIY

SEQ ID NO: 1824 - protein, 15 aa, Artificial Sequence
  Description of Artificial Sequence: Synthetic H124A VL FR2
WYQQRPGQSPRRLIY

SEQ ID NO: 1825 - protein, 15 aa, Artificial Sequence
  Description of Artificial Sequence: Synthetic H124A VL FR2
WFQQRPGQSPRLLIY

SEQ ID NO: 1826 - protein, 15 aa, Artificial Sequence
  Description of Artificial Sequence: Synthetic H124A VL FR2
WYQQRPGQSPRLLIY

SEQ ID NO: 1827 - protein, 25 aa, Artificial Sequence
  Description of Artificial Sequence: Synthetic H259A VH FR1
QVQLVQSGAEVKKPGASVKMSCKAS

SEQ ID NO: 1828 - protein, 25 aa, Artificial Sequence
  Description of Artificial Sequence: Synthetic H259A VH FR1
QVQLVQSGAEVVKPGASVKMSCKAS

SEQ ID NO: 1829 - protein, 10 aa, Artificial Sequence
  Description of Artificial Sequence: Synthetic H259A VH CDR2
YIYPYQDGTK

SEQ ID NO: 1830 - protein, 10 aa, Artificial Sequence
  Description of Artificial Sequence: Synthetic H259A VH CDR2
YIYPYSDGTK

SEQ ID NO: 1831 - protein, 10 aa, Artificial Sequence
  Description of Artificial Sequence: Synthetic H259A VH CDR2
YIYPYADGTK

SEQ ID NO: 1832 - protein, 10 aa, Artificial Sequence
  Description of Artificial Sequence: Synthetic H259A VH CDR2
YIYPYDDGTK

SEQ ID NO: 1833 - protein, 10 aa, Artificial Sequence
  Description of Artificial Sequence: Synthetic H259A VH CDR2
YIYPYNEGTK

SEQ ID NO: 1834 - protein, 10 aa, Artificial Sequence
  Description of Artificial Sequence: Synthetic H259A VH CDR2
YIYPYNSGTK

SEQ ID NO: 1835 - protein, 10 aa, Artificial Sequence
  Description of Artificial Sequence: Synthetic H259A VH CDR2
YIYPYNAGTK

SEQ ID NO: 1836 - protein, 10 aa, Artificial Sequence
  Description of Artificial Sequence: Synthetic H259A VH CDR2
YIYPYQEGTK

SEQ ID NO: 1837 - protein, 10 aa, Artificial Sequence
  Description of Artificial Sequence: Synthetic H259A VH CDR2
YIYPYQSGTK

SEQ ID NO: 1838 - protein, 10 aa, Artificial Sequence
  Description of Artificial Sequence: Synthetic H259A VH CDR2
YIYPYQAGTK

SEQ ID NO: 1839 - protein, 10 aa, Artificial Sequence
  Description of Artificial Sequence: Synthetic H259A VH CDR2
YIYPYSEGTK

SEQ ID NO: 1840 - protein, 10 aa, Artificial Sequence
  Description of Artificial Sequence: Synthetic H259A VH CDR2
YIYPYSSGTK

SEQ ID NO: 1841 - protein, 10 aa, Artificial Sequence
  Description of Artificial Sequence: Synthetic H259A VH CDR2
YIYPYSAGTK

SEQ ID NO: 1842 - protein, 10 aa, Artificial Sequence
  Description of Artificial Sequence: Synthetic H259A VH CDR2
YIYPYAEGTK

SEQ ID NO: 1843 - protein, 10 aa, Artificial Sequence
  Description of Artificial Sequence: Synthetic H259A VH CDR2
YIYPYASGTK

SEQ ID NO: 1844 - protein, 10 aa, Artificial Sequence
  Description of Artificial Sequence: Synthetic H259A VH CDR2
YIYPYAAGTK

SEQ ID NO: 1845 - protein, 10 aa, Artificial Sequence
  Description of Artificial Sequence: Synthetic H259A VH CDR2
YIYPYDEGTK

SEQ ID NO: 1846 - protein, 10 aa, Artificial Sequence
  Description of Artificial Sequence: Synthetic H259A VH CDR2
YIYPYDSGTK

SEQ ID NO: 1847 - protein, 10 aa, Artificial Sequence
  Description of Artificial Sequence: Synthetic H259A VH CDR2
YIYPYDAGTK

SEQ ID NO: 1848 - protein, 39 aa, Artificial Sequence
  Description of Artificial Sequence: Synthetic H259A VH FR3
YAQKFQGRVTMTFDTSTSTVYMELSSLRSEDTAVYYCAR

SEQ ID NO: 1849 - protein, 39 aa, Artificial Sequence
  Description of Artificial Sequence: Synthetic H259A VH FR3
YNQKFQGRVTMTFDTSTSTVYMELSSLRSEDTAVYYCAR

SEQ ID NO: 1850 - protein, 39 aa, Artificial Sequence
  Description of Artificial Sequence: Synthetic H259A VH FR3
YAQKFQGRATMTFDTSTSTVYMELSSLRSEDTAVYYCAR

SEQ ID NO: 1851 - protein, 39 aa, Artificial Sequence
  Description of Artificial Sequence: Synthetic H259A VH FR3
YAQKFQGRVTLTFDTSTSTVYMELSSLRSEDTAVYYCAR

SEQ ID NO: 1852 - protein, 39 aa, Artificial Sequence
  Description of Artificial Sequence: Synthetic H259A VH FR3
YAQKFQGRVTMTFDKSTSTVYMELSSLRSEDTAVYYCAR

SEQ ID NO: 1853 - protein, 39 aa, Artificial Sequence
  Description of Artificial Sequence: Synthetic H259A VH FR3
YAQKFQGRVTMTFDTSTSTAYMELSSLRSEDTAVYYCAR

SEQ ID NO: 1854 - protein, 39 aa, Artificial Sequence
  Description of Artificial Sequence: Synthetic H259A VH FR3
YNQKFQGRATMTFDTSTSTVYMELSSLRSEDTAVYYCAR

SEQ ID NO: 1855 - protein, 39 aa, Artificial Sequence
  Description of Artificial Sequence: Synthetic H259A VH FR3
YNQKFQGRVTLTFDTSTSTVYMELSSLRSEDTAVYYCAR

SEQ ID NO: 1856 - protein, 39 aa, Artificial Sequence
  Description of Artificial Sequence: Synthetic H259A VH FR3
YNQKFQGRVTMTFDKSTSTVYMELSSLRSEDTAVYYCAR

SEQ ID NO: 1857 - protein, 39 aa, Artificial Sequence
  Description of Artificial Sequence: Synthetic H259A VH FR3
YNQKFQGRVTMTFDTSTSTAYMELSSLRSEDTAVYYCAR

SEQ ID NO: 1858 - protein, 39 aa, Artificial Sequence
  Description of Artificial Sequence: Synthetic H259A VH FR3
YAQKFQGRATLTFDTSTSTVYMELSSLRSEDTAVYYCAR

SEQ ID NO: 1859 - protein, 39 aa, Artificial Sequence
  Description of Artificial Sequence: Synthetic H259A VH FR3
YAQKFQGRATMTFDKSTSTVYMELSSLRSEDTAVYYCAR

SEQ ID NO: 1860 - protein, 39 aa, Artificial Sequence
  Description of Artificial Sequence: Synthetic H259A VH FR3
YAQKFQGRATMTFDTSTSTAYMELSSLRSEDTAVYYCAR

SEQ ID NO: 1861 - protein, 39 aa, Artificial Sequence
  Description of Artificial Sequence: Synthetic H259A VH FR3
YAQKFQGRVTLTFDKSTSTVYMELSSLRSEDTAVYYCAR

SEQ ID NO: 1862 - protein, 39 aa, Artificial Sequence
  Description of Artificial Sequence: Synthetic H259A VH FR3
YAQKFQGRVTLTFDTSTSTAYMELSSLRSEDTAVYYCAR

SEQ ID NO: 1863 - protein, 39 aa, Artificial Sequence
  Description of Artificial Sequence: Synthetic H259A VH FR3
YAQKFQGRVTMTFDKSTSTAYMELSSLRSEDTAVYYCAR

SEQ ID NO: 1864 - protein, 39 aa, Artificial Sequence
  Description of Artificial Sequence: Synthetic H259A VH FR3
YNQKFQGRATLTFDTSTSTVYMELSSLRSEDTAVYYCAR

SEQ ID NO: 1865 - protein, 39 aa, Artificial Sequence
  Description of Artificial Sequence: Synthetic H259A VH FR3
YNQKFQGRVTLTFDKSTSTVYMELSSLRSEDTAVYYCAR

SEQ ID NO: 1866 - protein, 39 aa, Artificial Sequence
  Description of Artificial Sequence: Synthetic H259A VH FR3
YNQKFQGRVTLTFDTSTSTAYMELSSLRSEDTAVYYCAR

SEQ ID NO: 1867 - protein, 39 aa, Artificial Sequence
  Description of Artificial Sequence: Synthetic H259A VH FR3
YNQKFQGRVTMTFDKSTSTAYMELSSLRSEDTAVYYCAR

SEQ ID NO: 1868 - protein, 39 aa, Artificial Sequence
  Description of Artificial Sequence: Synthetic H259A VH FR3
YAQKFQGRATLTFDKSTSTVYMELSSLRSEDTAVYYCAR

SEQ ID NO: 1869 - protein, 39 aa, Artificial Sequence
  Description of Artificial Sequence: Synthetic H259A VH FR3
YAQKFQGRATLTFDTSTSTAYMELSSLRSEDTAVYYCAR

SEQ ID NO: 1870 - protein, 39 aa, Artificial Sequence
  Description of Artificial Sequence: Synthetic H259A VH FR3
YAQKFQGRATMTFDKSTSTAYMELSSLRSEDTAVYYCAR

SEQ ID NO: 1871 - protein, 39 aa, Artificial Sequence
  Description of Artificial Sequence: Synthetic H259A VH FR3
YAQKFQGRVTLTFDKSTSTAYMELSSLRSEDTAVYYCAR

SEQ ID NO: 1872 - protein, 39 aa, Artificial Sequence
  Description of Artificial Sequence: Synthetic H259A VH FR3
YNQKFQGRATLTFDKSTSTVYMELSSLRSEDTAVYYCAR

SEQ ID NO: 1873 - protein, 39 aa, Artificial Sequence
  Description of Artificial Sequence: Synthetic H259A VH FR3
YNQKFQGRATLTFDTSTSTAYMELSSLRSEDTAVYYCAR

SEQ ID NO: 1874 - protein, 39 aa, Artificial Sequence
  Description of Artificial Sequence: Synthetic H259A VH FR3
YAQKFQGRATLTFDKSTSTAYMELSSLRSEDTAVYYCAR

SEQ ID NO: 1875 - protein, 39 aa, Artificial Sequence
  Description of Artificial Sequence: Synthetic H259A VH FR3
YNQKFQGRATLTFDKSTSTAYMELSSLRSEDTAVYYCAR

SEQ ID NO: 1876 - protein, 23 aa, Artificial Sequence
  Description of Artificial Sequence: Synthetic H259A VL FR1
DIVLTQSPLSLPVTPGEPASISC

SEQ ID NO: 1877 - protein, 23 aa, Artificial Sequence
  Description of Artificial Sequence: Synthetic H259A VL FR1
DVVLTQSPLSLPVTPGEPASISC

SEQ ID NO: 1878 - protein, 16 aa, Artificial Sequence
  Description of Artificial Sequence: Synthetic H259A VL CDR1
KSTKSLLQSDGFTYLD

SEQ ID NO: 1879 - protein, 16 aa, Artificial Sequence
  Description of Artificial Sequence: Synthetic H259A VL CDR1
KSTKSLLSSDGFTYLD

SEQ ID NO: 1880 - protein, 16 aa, Artificial Sequence
  Description of Artificial Sequence: Synthetic H259A VL CDR1
KSTKSLLASDGFTYLD

SEQ ID NO: 1881 - protein, 16 aa, Artificial Sequence
  Description of Artificial Sequence: Synthetic H259A VL CDR1
KSTKSLLDSDGFTYLD

SEQ ID NO: 1882 - protein, 16 aa, Artificial Sequence
  Description of Artificial Sequence: Synthetic H259A VL CDR1
KSTKSLLNSEGFTYLD

SEQ ID NO: 1883 - protein, 16 aa, Artificial Sequence
  Description of Artificial Sequence: Synthetic H259A VL CDR1
KSTKSLLNSSGFTYLD

SEQ ID NO: 1884 - protein, 16 aa, Artificial Sequence
  Description of Artificial Sequence: Synthetic H259A VL CDR1
KSTKSLLNSAGFTYLD

SEQ ID NO: 1885 - protein, 16 aa, Artificial Sequence
  Description of Artificial Sequence: Synthetic H259A VL CDR1
KSTKSLLQSEGFTYLD

SEQ ID NO: 1886 - protein, 16 aa, Artificial Sequence
  Description of Artificial Sequence: Synthetic H259A VL CDR1
KSTKSLLQSSGFTYLD

SEQ ID NO: 1887 - protein, 16 aa, Artificial Sequence
  Description of Artificial Sequence: Synthetic H259A VL CDR1
KSTKSLLQSAGFTYLD

SEQ ID NO: 1888 - protein, 16 aa, Artificial Sequence
  Description of Artificial Sequence: Synthetic H259A VL CDR1
KSTKSLLSSEGFTYLD

SEQ ID NO: 1889 - protein, 16 aa, Artificial Sequence
  Description of Artificial Sequence: Synthetic H259A VL CDR1
KSTKSLLSSSGFTYLD

SEQ ID NO: 1890 - protein, 16 aa, Artificial Sequence
  Description of Artificial Sequence: Synthetic H259A VL CDR1
KSTKSLLSSAGFTYLD

SEQ ID NO: 1891 - protein, 16 aa, Artificial Sequence
  Description of Artificial Sequence: Synthetic H259A VL CDR1
KSTKSLLASEGFTYLD

SEQ ID NO: 1892 - protein, 16 aa, Artificial Sequence
  Description of Artificial Sequence: Synthetic H259A VL CDR1
KSTKSLLASSGFTYLD

SEQ ID NO: 1893 - protein, 16 aa, Artificial Sequence
  Description of Artificial Sequence: Synthetic H259A VL CDR1
KSTKSLLASAGFTYLD

SEQ ID NO: 1894 - protein, 16 aa, Artificial Sequence
  Description of Artificial Sequence: Synthetic H259A VL CDR1
KSTKSLLDSEGFTYLD

SEQ ID NO: 1895 - protein, 16 aa, Artificial Sequence
  Description of Artificial Sequence: Synthetic H259A VL CDR1
KSTKSLLDSSGFTYLD

SEQ ID NO: 1896 - protein, 16 aa, Artificial Sequence
  Description of Artificial Sequence: Synthetic H259A VL CDR1
KSTKSLLDSAGFTYLD

SEQ ID NO: 1897 - protein, 7 aa, Artificial Sequence
  Description of Artificial Sequence: Synthetic H259A VL CDR2
LISQRFS

SEQ ID NO: 1898 - protein, 7 aa, Artificial Sequence
  Description of Artificial Sequence: Synthetic H259A VL CDR2
LISSRFS

SEQ ID NO: 1899 - protein, 7 aa, Artificial Sequence
  Description of Artificial Sequence: Synthetic H259A VL CDR2
LISARFS

SEQ ID NO: 1900 - protein, 7 aa, Artificial Sequence
  Description of Artificial Sequence: Synthetic H259A VL CDR2
LISDRFS

SEQ ID NO: 1901 - protein, 32 aa, Artificial Sequence
  Description of Artificial Sequence: Synthetic H259A VL FR3
GVPDRFSGSGSGTDFTLKISRVEAEDVGLYYC

SEQ ID NO: 1902 - protein, 98 aa, Artificial Sequence
  Description of Artificial Sequence: Synthetic Human germlineIMGT IGHV1-46*01 heavy chain
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 1903 - protein, 98 aa, Artificial Sequence
  Description of Artificial Sequence: Synthetic Human germlineIMGT IGHV3-74*01 heavy chain
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAR

SEQ ID NO: 1904 - protein, 99 aa, Artificial Sequence
  Description of Artificial Sequence: Synthetic Human germlineIMGT IGHV4-61*01 heavy chain
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAR

SEQ ID NO: 1905 - protein, 101 aa, Artificial Sequence
  Description of Artificial Sequence: Synthetic Human germlineIMGT IGKV2-28*01 light chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPP

SEQ ID NO: 1906 - protein, 101 aa, Artificial Sequence
  Description of Artificial Sequence: Synthetic Human germlineIMGT IGKV2-29*02 light chain
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPP

SEQ ID NO: 1907 - protein, 96 aa, Artificial Sequence
  Description of Artificial Sequence: Synthetic Human germlineIMGT IGKV1-39*01 light chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP

SEQ ID NO: 1908 - protein, 97 aa, Artificial Sequence
  Description of Artificial Sequence: Synthetic Human germlineIMGT IGKV3-20*01 light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPP

SEQ ID NO: 1909 - protein, 97 aa, Artificial Sequence
  Description of Artificial Sequence: Synthetic Human germlineIMGT IGKV3D-20*01 light chain
EIVLTQSPATLSLSPGERATLSCGASQSVSSSYLAWYQQKPGLAPRLLIYDASSRATGIPDRFSGSGSGTDFTLTISRLEPEDFAVYYCQQYGSSPP

SEQ ID NO: 1910 - protein, 96 aa, Artificial Sequence
  Description of Artificial Sequence: Synthetic Human germlineIMGT IGKV3-11*01 light chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPP

SEQ ID NO: 1911 - protein, 101 aa, Artificial Sequence
  Description of Artificial Sequence: Synthetic Human germlineIMGT IGKV2-30*01 light chain
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPP

SEQ ID NO: 1912 - protein, 101 aa, Artificial Sequence
  Description of Artificial Sequence: Synthetic Human germlineIMGT IGKV2-30*02 light chain
DVVMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPP

SEQ ID NO: 1913 - protein, 102 aa, Artificial Sequence
  Description of Artificial Sequence: Synthetic Human germlineIMGT IGKV4-1*01 light chain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPP

SEQ ID NO: 1914 - protein, 193 aa, Artificial Sequence
  Description of Artificial Sequence: Synthetic consensus of human and mouse C10orf54 protein
  MOD_RES (5)..(5): Thr or Ala
  MOD_RES (6)..(6): Ala or Val
  MOD_RES (7)..(7): Leu or Pro
  MOD_RES (10)..(10): Gly or Ser
  MOD_RES (12)..(12): Trp or Pro
  MOD_RES (16)..(16): Ser or Thr
  MOD_RES (19)..(19): Phe or Leu
  MOD_RES (21)..(21): Leu or Ile
  MOD_RES (27)..(27): Leu or Arg
  MOD_RES (29)..(29): Pro or Leu
  MOD_RES (36)..(36): Ala or Thr
  MOD_RES (50)..(50): Val or Ala
  MOD_RES (56)..(56): Leu or Ile
  MOD_RES (61)..(61): Asp or Ser
  MOD_RES (68)..(68): Phe or Ile
  MOD_RES (74)..(74): Arg or Leu
  MOD_RES (82)..(82): Thr or Met
  MOD_RES (84)..(84): Ser or Lys
  MOD_RES (86)..(86): Arg or His
  MOD_RES (92)..(92): Leu or Phe
  MOD_RES (94)..(94): Phe or Leu
  MOD_RES (96)..(96): Asp or His
  MOD_RES (98)..(98): His or Gln
  MISC_FEATURE (99)..(99): May or may not be present
  MOD_RES (103)..(103): Gly or Ser
  MOD_RES (105)..(105): Gln or Leu
  MOD_RES (106)..(106): Ala or Lys
  MOD_RES (109)..(109): Thr or Ala
  MOD_RES (113)..(113): Leu or Gln
  MOD_RES (114)..(114): Ala or Pro
  MOD_RES (116)..(116): Arg or Lys
  MOD_RES (121)..(121): Ser or Leu
  MOD_RES (133)..(133): Met or Leu
  MOD_RES (136)..(136): Leu or Val
  MOD_RES (138)..(138): Leu or Pro
  MOD_RES (139)..(139): Leu or Arg
  MOD_RES (149)..(149): Val or Ile
  MOD_RES (151)..(151): Ile or Leu
  MOD_RES (152)..(152): Arg or Lys
  MOD_RES (153)..(153): His or Asn
  MOD_RES (156)..(156): Ser or Pro
  MOD_RES (158)..(158): His or Gln
  MOD_RES (160)..(160): Val or Phe
  MOD_RES (161)..(161): His or Tyr
  MOD_RES (163)..(163): Ala or Ser
  MOD_RES (170)..(170): Thr or Ala
  MOD_RES (173)..(173): Asp or Gly
  MOD_RES (174)..(174): Ala or Ser
  MOD_RES (175)..(175): Pro or Gly
  MOD_RES (177)..(177): Asn or Thr
  MOD_RES (179)..(179): Val or Met
  MOD_RES (180)..(180): Val or Ala
  MISC_FEATURE (181)..(181): May or may not be present
  MISC_FEATURE (182)..(182): May or may not be present
  MOD_RES (184)..(184): Ser or Asn
  MOD_RES (185)..(185): Ser or Glu
  MOD_RES (189)..(189): Glu or Asp
  MOD_RES (190)..(190): Asn or Ser
MGVPXXXEAXSXRWGXLLXAXFLAASXGXVAAFKVXTPYSLYVCPEGQNXTLTCRXLGPVXKGHDVTXYKTWYXSSRGEVQXCXEXRPIRNXTXQXLXLHHGXHXXANXSHDXXQXHGLEXASDHHGNFSITXRNXTXXDSGLYCCLVXEXXXHHXEXRXXGXMELQVQXGKXXXSXCXXYPSXXQDSXXITA

SEQ ID NO: 1915 - protein, 8 aa, Artificial Sequence
  Description of Artificial Sequence: Synthetic 164A VL CDR1 #2 according to Contact
SSSNLHWY

SEQ ID NO: 1916 - DNA, 417 bp, Artificial Sequence
  Description of Artificial Sequence: Synthetic 230A heavy chain variable region with signal sequence
atgggatggacctggatctttattttaatcctgtcagtaactacaggtgtccactctgaggtccagctgcagcagtctggacctgagctggagaagcctggcgcttcagtgaagatatcctgcaaggcttctggttactcattcactggctccaacatgaactgggtgaagcagaacaatggaaagagccttgagtggattggaaatattgatccttactatggttatactacctacaaccagaagttcaagggcaaggccacattgactgtagacaaatcctccagcacagcctacatgcagctcaagagcctgacatctgaggactctgcagtctattactgtgcaagagactatgattacgccctcgggtacttcgatgtctggggcgcagggaccacggtcaccgtctcctca

SEQ ID NO: 1917 - protein, 13 aa, Artificial Sequence
  Description of Artificial Sequence: Synthetic 124A VH CDR2 according to Contact
WMGEILPGSGSTS

SEQ ID NO: 1918 - protein, 10 aa, Artificial Sequence
  Description of Artificial Sequence: Synthetic consensus CDRs of VH by paratope group (Fig. 18)
GYTFSRYWIE

SEQ ID NO: 1919 - protein, 17 aa, Artificial Sequence
  Description of Artificial Sequence: Synthetic consensus CDRs of VH by paratope group (Fig. 18)
EILPGSGSTNYNEKFKG

SEQ ID NO: 1920 - protein, 12 aa, Artificial Sequence
  Description of Artificial Sequence: Synthetic consensus CDRs of VH by paratope group (Fig. 18)
EEVYDGYPWFGY

SEQ ID NO: 1921 - protein, 10 aa, Artificial Sequence
  Description of Artificial Sequence: Synthetic consensus CDRs of VH by paratope group (Fig. 18)
RASSSLSYMH

SEQ ID NO: 1922 - protein, 7 aa, Artificial Sequence
  Description of Artificial Sequence: Synthetic consensus CDRs of VH by paratope group (Fig. 18)
ATSNLAS

SEQ ID NO: 1923 - protein, 9 aa, Artificial Sequence
  Description of Artificial Sequence: Synthetic consensus CDRs of VH by paratope group (Fig. 18)
QQWSSNPYT

SEQ ID NO: 1924 - protein, 11 aa, Artificial Sequence
  Description of Artificial Sequence: Synthetic peptide
EYYGTSLMQWF

SEQ ID NO: 1925 - protein, 23 aa, Homo sapiens
EPKSCDKTHTCPPCPAPELLGGP

SEQ ID NO: 1926 - protein, 19 aa, Homo sapiens
ERKCCVECPPCPAPPVAGP

SEQ ID NO: 1927 - protein, 70 aa, Homo sapiens
ELKTPLGDTTHTCPRCPEPKSCDTPPPCPRCPEPKSCDTPPPCPRCPEPKSCDTPPPCPRCPAPELLGGP

SEQ ID NO: 1928 - protein, 20 aa, Homo sapiens
ESKYGPPCPSCPAPEFLGGP

SEQ ID NO: 1929 - protein, 15 aa, Homo sapiens
EPKSCDKTHTCPPCP

SEQ ID NO: 1930 - protein, 12 aa, Homo sapiens
ERKCCVECPPCP

SEQ ID NO: 1931 - protein, 17 aa, Homo sapiens
ELKTPLGDTTHTCPRCP

SEQ ID NO: 1932 - protein, 15 aa, Homo sapiens
EPKSCDTPPPCPRCP

SEQ ID NO: 1933 - protein, 12 aa, Homo sapiens
ESKYGPPCPSCP

SEQ ID NO: 1934 - protein, 19 aa, Artificial Sequence
  Description of Artificial Sequence: Synthetic peptide
MGWTWIFILILSVTTGVHS

SEQ ID NO: 1935 - protein, 19 aa, Artificial Sequence
  Description of Artificial Sequence: Synthetic peptide
MEWTWVFLFLLSVTAGVHS

SEQ ID NO: 1936 - protein, 19 aa, Artificial Sequence
  Description of Artificial Sequence: Synthetic peptide
MEWTWVFLFLLSVTAGVHS

SEQ ID NO: 1937 - protein, 19 aa, Artificial Sequence
  Description of Artificial Sequence: Synthetic peptide
MKLPVRLLVLMFWIPASSS

SEQ ID NO: 1938 - protein, 22 aa, Artificial Sequence
  Description of Artificial Sequence: Synthetic peptide
MDFQVQIFSFLLISASVIMSRG

SEQ ID NO: 1939 - protein, 19 aa, Artificial Sequence
  Description of Artificial Sequence: Synthetic peptide
MKLPVRLLVLMFWIPASSS

SEQ ID NO: 1940 - protein, 6 aa, Artificial Sequence
  Description of Artificial Sequence: Synthetic 6xHis tag
HHHHHH

What is claimed:

1. An isolated antibody or antigen-binding fragment thereof that binds to a C10orf54 protein, comprising:
    a heavy chain comprising the following three CDRs, respectively CDR-H1 having the sequence SEQ ID NO: 1296, CDR-H2 having a sequence selected from SEQ ID NO: 1358, SEQ ID NO. 1556, SEQ ID NO. 1557, SEQ ID NO. 1558, and SEQ ID NO. 1559, and CDR-H3 having the sequence SEQ ID No. 1393; and
    a light chain comprising the following three CDRs, respectively CDR-L1 having the sequence SEQ ID No. 1435, CDR-L2 having a sequence selected from SEQ ID NO: 1476, SEQ ID NO. 1630, SEQ ID NO. 1631, SEQ ID NO. 1632, and SEQ ID NO. 1633, and CDR-L3 having the sequence SEQ ID No. 1499.

2. The antibody of claim 1, or the antigen-binding fragment thereof, wherein said antibody is humanized.

3. The antibody according to claim 2, or the antigen-binding fragment thereof, said antibody comprising a heavy chain variable domain of sequence selected between amino acid sequences SEQ ID NO. 1529, SEQ ID NO. 1530, and SEQ ID NO. 1531, and a light chain variable domain of sequence selected between amino acid sequences SEQ ID NO. 1532, SEQ ID NO. 1533, and SEQ ID NO. 1534.

4. The antibody of claim 1, wherein the antibody is a Fab fragment, F(ab')2 fragment, single chain Fv (sFv), diabody, triabody, or minibody.

5. The antibody of claim 1, or antigen-binding fragment thereof, wherein said antibody is a monoclonal antibody.

6. An antibody-drug conjugate comprising the antibody of claim 1 conjugated to a cytotoxic agent.

7. A pharmaceutical composition comprising the antibody of claim 1 and a pharmaceutically acceptable diluent, carrier or excipient.

8. A pharmaceutical composition comprising the antibody-drug conjugate of claim 6 and a pharmaceutically acceptable diluent, carrier or excipient.

9. A kit comprising the antibody of claim 1.

10. The kit of claim 9, wherein said antibody is conjugated to a detectable substrate.

11. A polynucleotide comprising a nucleotide sequence encoding the antibody of claim 1.

12. An expression vector comprising the polynucleotide of claim 11.

13. An isolated host cell comprising the expression vector of claim 12.

14. A method of producing the antibody or antigen-binding fragment thereof, of claim 1, said method comprising a step of culturing a host cell comprising an expression vector comprising a polynucleotide encoding the antibody of claim 1 under conditions that promote the production of the antibody.

15. A method of detecting, in vitro, a C10orf54 protein in a sample comprising contacting the sample with the antibody of claim 1.

* * * * *

UNITED STATES PATENT AND TRADEMARK OFFICE
CERTIFICATE OF CORRECTION

| | |
|---|---|
| PATENT NO. | : 10,766,959 B2 |
| APPLICATION NO. | : 15/534982 |
| DATED | : September 8, 2020 |
| INVENTOR(S) | : Lippincott et al. |

It is certified that error appears in the above-identified patent and that said Letters Patent is hereby corrected as shown below:

On the Title Page

The first or sole Notice should read --

Subject to any disclaimer, the term of this patent is extended or adjusted under 35 U.S.C. 154(b) by 2 days.

Signed and Sealed this
Thirty-first Day of August, 2021

Drew Hirshfeld
*Performing the Functions and Duties of the*
*Under Secretary of Commerce for Intellectual Property and*
*Director of the United States Patent and Trademark Office*